US010322141B2

(12) United States Patent
Haynes et al.

(10) Patent No.: US 10,322,141 B2
(45) Date of Patent: Jun. 18, 2019

(54) COMPOSITIONS COMPRISING CH848 ENVELOPES AND USES THEREOF

(71) Applicants: Duke University, Durham, NC (US); The Trustees of The University of Pennsylvania, Philadelphia, PA (US); Triad National Security, LLC, Los Alamos, NM (US)

(72) Inventors: Barton F. Haynes, Durham, NC (US); Beatrice H. Hahn, Philadelphia, PA (US); George M. Shaw, Philadelphia, PA (US); Bette T. Korber, Los Alamos, NM (US); Peter T. Hraber, Los Alamos, NM (US)

(73) Assignees: DUKE UNIVERSITY, Durham, NC (US); TRIAD NATIONAL SECURITY, LLC, Los Alamos, NM (US); THE TRUSTEES OF THE UNIVERSITY OF PENNSYLVANIA, Philadelphia, PA (US)

( * ) Notice: Subject to any disclaimer, the term of this patent is extended or adjusted under 35 U.S.C. 154(b) by 0 days.

(21) Appl. No.: 15/300,051

(22) PCT Filed: Mar. 31, 2015

(86) PCT No.: PCT/US2015/023632

§ 371 (c)(1),
(2) Date: Sep. 28, 2016

(87) PCT Pub. No.: WO2015/153638

PCT Pub. Date: Oct. 8, 2015

(65) Prior Publication Data

US 2017/0312303 A1 Nov. 2, 2017

Related U.S. Application Data

(60) Provisional application No. 61/972,649, filed on Mar. 31, 2014.

(51) Int. Cl.

| | |
|---|---|
| *A61K 39/12* | (2006.01) |
| *A61K 39/21* | (2006.01) |
| *C07K 14/00* | (2006.01) |
| *C07K 14/08* | (2006.01) |
| *C07K 14/15* | (2006.01) |
| *A61K 31/7088* | (2006.01) |
| *C07K 14/155* | (2006.01) |
| *A61K 39/00* | (2006.01) |

(52) U.S. Cl.

CPC .......... *A61K 31/7088* (2013.01); *A61K 39/12* (2013.01); *A61K 39/21* (2013.01); *C07K 14/155* (2013.01); *A61K 2039/70* (2013.01); *C12N 2740/16034* (2013.01)

(58) Field of Classification Search

CPC .. A61K 2039/70; A61K 31/711; A61K 39/12; A61K 39/21; C07K 14/00; C07K 14/08; C07K 14/15; C07K 14/155; C12N 2740/16011; C12N 2740/16034

See application file for complete search history.

(56) References Cited

U.S. PATENT DOCUMENTS

| | | | | |
|---|---|---|---|---|
| 7,655,774 B2 * | 2/2010 | Mullins | C07H 21/04 | 435/252.3 |
| 7,951,377 B2 | 5/2011 | Korber et al. | | |
| 8,048,431 B2 * | 11/2011 | Haynes | A61K 39/12 | 424/208.1 |
| 2004/0033487 A1 * | 2/2004 | Nabel | A61K 39/21 | 435/5 |
| 2014/0335126 A1 * | 11/2014 | Haynes | A61K 39/12 | 424/208.1 |

FOREIGN PATENT DOCUMENTS

| | | |
|---|---|---|
| WO | WO-2011/106100 A2 | 9/2011 |
| WO | WO-2011/109511 A2 | 9/2011 |
| WO | WO-2013/006688 A2 | 1/2013 |
| WO | WO-2013/052095 A2 | 4/2013 |
| WO | WO-2014/042669 A1 | 3/2014 |
| WO | WO-2015/153638 A1 | 10/2015 |

OTHER PUBLICATIONS

Aldovini and Young, Nature 351:479-482, 1991.*

Alam, S. M., et al., "Differential reactivity of germ line allelic variants of a broadly neutralizing HIV-1 antibody to a gp41 fusion intermediate conformation," J. Virol., vol. 85, No. 22, pp. 11725-11731 (Nov. 2011).

Arnaoty, A., et al., "Novel Approach for the Development of New Antibodies Directed Against Transposase-Derived Proteins Encoded by Human Neogenes," Yves Bigot (ed.), Mobile Genetic Elements: Protocols and Genomic Applications, Methods in Molecular Biology, vol. 859, Chapter 17, pp. 293-305 (2012).

Arnaoty, A., et al., "Reliability of the nanopheres-DNA immunization technology to produce polyclonal antibodies directed against human neogenic proteins," Mol. Genet. Genomics, vol. 288, pp. 347-363 (2013).

Barouch, D. H., et al., "Mosaic HIV-1 Vaccines Expand the Breadth and Depth of Cellular Immune Responses in Rhesus Monkeys," Nature Med., vol. 16, No. 3, pp. 319-323, Author Manuscript—15 total pages (Mar. 2010).

Batista, F. D. and Neuberger, M. S., "Affinity Dependence of the B Cell Response to Antigen: A Threshold, a Ceiling, and the Importance of Off-Rate," Immunity, vol. 8, pp. 751-759 (Jun. 1998).

(Continued)

*Primary Examiner* — Kevin K Hill

(74) *Attorney, Agent, or Firm* — Wilmer Cutler Pickering Hale and Dorr LLP

(57) ABSTRACT

In certain aspects the invention provides immunogenic compositions comprising CH848 HIV-1 envelopes and their use in methods to induce immune responses in subjects, e.g., human subjects.

14 Claims, 246 Drawing Sheets

Specification includes a Sequence Listing.

(56) References Cited

OTHER PUBLICATIONS

Bonsignori, M., et al., "Analysis of a Clonal Lineage of HIV-1 Envelope V2/V3 Conformational Epitope-Specific Broadly Neutralizing Antibodies and Their Inferred Unmutated Common Ancestors," J. Virol., vol. 85, No. 19, pp. 9998-10009 (Oct. 2011).

Bonsignori, M., et al., "Staged induction of HIV-1 glycan-dependent broadly neutralizing antibodies," Sci. Transl. Med., vol. 9, No. 381, Author Manuscript—26 pages (Mar. 15, 2017).

Burton, D. R., et al., "Broadly neutralizing antibodies suggest new prospects to counter highly antigenically diverse viruses," Science, vol. 337, No. 6091, pp. 183-186, Author Manuscript—10 total pages (Jul. 13, 2012).

Cany, J., et al., "AFP-specific immunotherapy impairs growth of autochthonous hepatocellular carcinoma in mice," Journal of Hepatology, vol. 54, pp. 115-121 (2011).

Chen, C., et al., "The site and stage of anti-DNA B-cell deletion," Nature, vol. 373, pp. 252-255 (Jan. 19, 1995).

Chen, W., et al., "All Known Cross-Reactive HIV-1 Neutralizing Antibodies are Highly Divergent from Germline and Their Elicitation May Require Prolonged Periods of Time," Abstracts from AIDS Vaccine 2008—Cape Town, South Africa, AIDS Res. Human Retrovir., vol. 24, Supplement 1, pp. 11-12, 3 pages in total (Oct. 13-16, 2008).

Corti, D., et al., "Analysis of Memory B Cell Responses and Isolation of Novel Monoclonal Antibodies with Neutralizing Breadth from HIV-1-Infected Individuals," PLoS One, vol. 5, Issue 1, e8805, pp. 1-15 (Jan. 2010).

Dimitrov, D., S., "Therapeutic antibodies, vaccines and antibodyomes," mAbs, vol. 2, No. 3, pp. 347-356 (May/Jun. 2010).

Goepfert, P., A., et al., "Specificity and 6-Month Durability of Immune Responses Induced by DNA and Recombinant Modified Vaccinia Ankara Vaccines Expressing HIV-1 Virus-Like Particles," J. Infect. Dis., vol. 210, pp. 99-110 (Jul. 1, 2014).

Graham, B., S., et al., "DNA Vaccine Delivered by a Needle-Free Injection Device Improves Potency of Priming for Antibody and CD8+ T-Cell Responses after rAd5 Boost in a Randomized Clinical Trial," PLoS ONE, vol. 8, Issue 4, e59340, pp. 1-11 (Apr. 2013).

Gray, E. S., et al., "The Neutralization Breadth of HIV-1 Develops Incrementally Over Four Years and Is Associated with $CD4^+$ T Cell Decline and High Viral Load during Acute Infection," J. Virol., vol. 85, No. 10, pp. 4828-4840 (May 2011).

Haynes, B. F., et al., "B-cell-lineage immunogen design in vaccine development with HIV-1 as a case study," Nat. Biotechnol., vol. 30, No. 5, pp. 423-433 (May 2012).

Haynes, B. F., et al., "Cardiolipin Polyspecific Autoreactivity in Two Broadly Neutralizing HIV-1 Antibodies," Science, vol. 308, pp. 1906-1908, 4 pages in total (Jun. 24, 2005).

Hoot, S., et al., "Recombinant HIV Envelope Proteins Fail to Engage Germline Versions of Anti-CD4bs bNAbs," PLoS Pathog., vol. 9, Issue 1, e1003106, pp. 1-15 (Jan. 3, 2013).

International Search Report and Written Opinion issued by the Korean Intellectual Property Office as International Searching Authority for International Application No. PCT/US2015/023632 dated Jul. 30, 2015 (12 pages).

Keele, B. F., et al., "Identification and characterization of transmitted and early founder virus envelopes in primary HIV-1 infection," Proc. Natl. Acad. Sci. USA, vol. 105, No. 21, pp. 7552-7557 (May 27, 2008).

Kepler, T. B. and Perelson, A. S., "Somatic Hypermutation in B Cells: An Optimal Control Treatment," J. Theo. Biol., vol. 164, pp. 37-64 (1993).

Kibler, K. V., et al., "Improved NYVAC-Based Vaccine Vectors," PLoS One, vol. 6, Issue 11, e25674, pp. 1-13 (Nov. 2011).

Klein, F., et al., "Broad neutralization by a combination of antibodies recognizing the CD4 binding site and a new conformational epitope on the HIV-1 envelope protein," J. Exp. Med., vol. 209, No. 8, pp. 1469-1479 (Jul. 23, 2012).

Kwong, P. D. and Mascola, J. R., "Human Antibodies that Neutralize HIV-1: Identification, Structures, and B Cell Ontogenies," Immunity, vol. 37, No. 3, pp. 412-425, Author Manuscript—27 total pages (Sep. 21, 2012).

Liao, H.-X., et al., "A Group M Consensus Envelope Glycoprotein Induces Antibodies That Neutralize Subsets of Subtype B and C HIV-1 Primary Viruses," Virology, vol. 353, pp. 268-282 (2006).

Liao, H.-X., et al., "Co-evolution of a broadly neutralizing HIV-1 antibody and founder virus," Nature, vol. 496, No. 7446, pp. 469-476, Author Manuscript—25 total pages (Apr. 25, 2013).

Liao, H.-X., et al., "Initial antibodies binding to HIV-1 gp41 in acutely infected subjects are polyreactive and highly mutated," JEM, vol. 208, No. 11, pp. 2237-2249 (Oct. 10, 2011).

Lynch, R. M., et al., "The Development of CD4 Binding Site Antibodies During HIV-1 Infection," J. Virol., vol. 86, No. 14, pp. 7588-7595 (Jul. 2012).

Ma, B.-J., et al., "Envelope Deglycosylation Enhances Antigenicity of HIV-1 gp41 Epitopes for Both Broad Neutralizing Antibodies and Their Unmutated Ancestor Antibodies," PLoS Pathog., vol. 7, Issue 9, e1002200, pp. 1-16 (Sep. 2011).

Mascola, J. R. and Haynes, B. F., "HIV-1 Neutralizing antibodies: understanding nature's pathways," Immunol. Rev., vol. 254, No. 1, pp. 225-244, Author Manuscript—29 total pages (Jul. 2013).

Meffre, E., et al., "Immunoglobulin heavy chain expression shapes the B cell receptor repertoire in human B cell development," The Journal of Clinical Investigation, vol. 108, No. 6, pp. 879-886 (Sep. 2001).

Montefiori, D.C., et al., Magnitude and Breadth of the Neutralizing Antibody Response in the RV144 and Vax003 HIV-1 Vaccine Efficacy Trials, JID, vol. 206, pp. 431-441 (Aug. 1, 2012).

Moody, M.A., et al., HIV-1 gp120 Vaccine Induces Affinity Maturation in both New and Persistent Antibody Clonal Lineages, J. Virol., vol. 86, No. 14, pp. 7496-7507 (Jul. 2012).

Moore, P. L., et al., "Potent and Broad Neutralization of HIV-1 Subtype C by Plasma Antibodies Targeting a Quaternary Epitope Including Residues in the V2 Loop," J. Virol., vol. 85, No. 7, pp. 3128-3141 (Apr. 2011).

Moore, P. L., et al., "Specificity of the autologous neutralizing antibody response," Curr. Opin. HIV AIDS, vol. 4, No. 5, pp. 358-363, Author Manuscript—11 total pages (Sep. 2009).

Mouquet, H. and Nussenzweig, M. C., "Polyreactive antibodies in adaptive immune responses to viruses," Cell Mol. Life Sci., vol. 69, pp. 1435-1445 (2012).

Mouquet, H., et al., "Polyreactivity increases the apparent affinity of anti-HIV antibodies by heteroligation," Nature, vol. 467, No. 7315, pp. 591-595, Author Manuscript—15 total pages (Sep. 30, 2010).

Pancera, M., et al., "Crystal Structure of PG16 and Chimeric Dissection with Somatically Related PG9: Structure-Function Analysis of Two Quaternary-Specific Antibodies that Effectively Neutralize HIV-1," Journal of Virology, vol. 84, No. 16, pp. 8098-8110 (Aug. 2010).

Perreau, M., et al., "DNA/NYVAC Vaccine Regimen Induces HIV-Specific CD4 and CD8 T-Cell Responses in Intestinal Mucosa," J. Virology, vol. 85, No. 19, pp. 9854-9862 (Oct. 2011).

Ping, L.-H., et al., "Comparison of Viral Env Proteins from Acute and Chronic Infections with Subtype C Human Immunodeficiency Virus Type 1 Identifies Differences in Glycosylation and CCR5 Utilization and Suggests a New Strategy for Immunogen Design," Journal of Virology, vol. 87, No. 13, pp. 7218-7233 (Jul. 2013).

Richman, D. D., et al., "Rapid evolution of the neutralizing antibody response to HIV type 1 infection," Proc. Natl. Acad. Sci. USA, vol. 100, No. 7, pp. 4144-4149 (Apr. 1, 2003).

Santra, S., et al., "Mosaic Vaccines Elicit CD8+ T lymphocyte Responses in Monkeys that Confer Enhanced Immune Coverage of Diverse HIV Strains," Nature Med., vol. 16, No. 3, pp. 324-328, Author Manuscript—13 total pages (Mar. 2010).

Sattentau, Q. J. and McMichael, A. J., "New templates for HIV-1 antibody-based vaccine design," F1000 Biol. Rep., vol. 2, No. 60, pp. 1-6 (Aug. 9, 2010).

Scheid, J. F., et al., "Broad diversity of neutralizing antibodies isolated from memory B cells in HIV-infected individuals," Nature, vol. 458, pp. 636-640 (Apr. 2, 2009).

(56) References Cited

OTHER PUBLICATIONS

Scheid, J. F., et al., "Sequence and Structural Convergence of Broad and Potent HIV Antibodies That Mimic CD4 Binding," Science, vol. 333, No. 6049, pp. 1633-1637, Author Manuscript—11 total pages (Sep. 16, 2011).
Shiokawa, S., et al., "IgM Heavy Chain Complementarity-Determining Region 3 Diversity Is Constrained by Genetic and Somatic Mechanisms Until Two Months After Birth," J. Immunol., vol. 162, pp. 6060-6070, 12 pages total (1999).
Stamatatos, L., "HIV vaccine design: the neutralizing antibody conundrum," Curr. Opin. Immunol., vol. 24, pp. 316-323 (May 15, 2012).
Tomaras, G. D., et al., "Polyclonal B Cell Responses to Conserved Neutralization Epitopes in a Subset of HIV-1-Infected Individuals," J. Virol., vol. 85, No. 21, pp. 11502-11519 (Nov. 2011).
Tomaras, G. D., et al., "Initial B-Cell Responses to Transmitted Human Immunodeficiency Virus Type 1: Virion-Binding Immunoglobulin M (IgM) and IgG Antibodies Followed by Plasma Anti-gp41 Antibodies with Ineffective Control of Initial Viremia," J. Virol., vol. 82, No. 24, pp. 12449-12463 (Dec. 2008).
Verkoczy, L., et al., "Autoreactivity in an HIV-1 broadly reactive neutralizing antibody variable region heavy chain induces immunologic tolerance," PNAS, vol. 107, No. 1, pp. 181-186 (Jan. 5, 2010).
Verkoczy, L., et al., "Rescue of HIV-1 Broad Neutralizing Antibody-Expressing B Cells in 2F5 $V_H \times V_L$ Knockin Mice Reveals Multiple Tolerance Controls," J. Immunol., vol. 187, pp. 3785-3797 (2011).
Walker, L. M., et al., "Broad and Potent Neutralizing Antibodies from an African Donor Reveal a New HIV-1 Vaccine Target," Science, vol. 326, No. 5950, pp. 285-289, Author Manuscript—10 total pages (Oct. 9, 2009).
Walker, L. M., et al., "Broad neutralization coverage of HIV by multiple highly potent antibodies," Nature, vol. 477, No. 7365, pp. 466-470, Author Manuscript—14 total pages (Sep. 22, 2011).
Wu, X., et al., "Focused Evolution of HIV-1 Neutralizing Antibodies Revealed by Structures and Deep Sequencing," Science, vol. 333, No. 6049, pp. 1593-1602, Author Manuscript—17 total pages (Sep. 16, 2011).
Wu, X., et al., "Rational Design of Envelope Identifies Broadly Neutralizing Human Monoclonal Antibodies to HIV-1," Science, vol. 329, pp. 856-861 (Aug. 13, 2010).
Xiao, X., et al., "Germline-like predecessors of broadly neutralizing antibodies lack measurable binding to HIV-1 envelope glycoproteins: implications for evasion of immune responses and design of vaccine immunogens," Biochem. Biophys. Res. Commun., vol. 390, No. 3, pp. 404-409, Author Manuscript—14 total pages (Dec. 18, 2009).
Yu, J.-S., et al., "Generation of mucosal anti-human immunodeficiency virus type 1 T-cell responses by recombinant *Mycobacterium smegmatis*," Clin. Vaccine Immunol., vol. 13, No. 11, pp. 1204-1211 (Nov. 2006).

Yu, J.-S., et al., "Recombinant *Mycobacterium bovis* Bacillus Calmette-Guérin Elicits Human Immunodeficiency Virus Type 1 Envelope-Specific T Lymphocytes at Mucosal Sites," Clinical Vaccine Immunol., vol. 14, No. 7, pp. 886-893 (Jul. 2007).
Zhang, J. and Shakhnovich, E. I., "Optimality of Mutation and Selection in Germinal Centers," PloS Comp. Biol., vol. 6, Issue 6, e1000800, pp. 1-9 (Jun. 2010).
Zhou, T., et al., "Structural Basis for Broad and Potent Neutralization of HIV-1 by Antibody VRC01," Science, vol. 329, No. 5993, pp. 811-817, Author Manuscript—19 total pages (Aug. 13, 2010).
NCBI, envelope glycoprotein [Human immunodeficiency virus 1], GenBank Accession No. AGV34666.1, 3 total pages (Sep. 16, 2013).
Binley, J.M., et al., "Enhancing the Proteolytic Maturation of Human Immunodeficiency Virus Type 1 Envelope Glycoproteins," Journal of Virology, vol. 76, No. 6, pp. 2606-2616 (Mar. 2002).
Bosch, V. and Pawlita, M., "Mutational Analysis of the Human Immunodeficiency Virus Type 1 env Gene Product Proteolytic Cleavage Site," Journal of Virology, vol. 64, No. 5, pp. 2337-2344 (May 1990).
Chakrabarti, B.K., et al., "Modifications of the Human Immunodeficiency Virus Envelope Glycoprotein Enhance Immunogenicity for Genetic Immunization," Journal of Virology, vol. 76, No. 11, pp. 5357-5368 (Jun. 2002).
Gao, F. et al., "Antigenicity and Immunogenicity of a Synthetic Human Immunodeficiency Virus Type 1 Group M Consensus Envelope Glycoprotein," Journal of Virology, vol. 79, No. 2, pp. 1154-1163 (Jan. 2005).
Guo, H.-G., et al., "Characterization of an HIV-1 Point Mutant Blocked in Envelope Glycoprotein Cleavage," Virology, vol. 174, pp. 217-224 (1990).
Haim, H., et al., "Proteolytic Processing of the Human Immunodeficiency Virus Envelope Glycoprotein Precursor Decreases Conformational Flexibility," Journal of Virology, vol. 87, No. 3, pp. 1884-1889 (Feb. 2013).
Li, Y., et al., "Control of expression, glycosylation, and secretion of HIV-1 gp120 by homologous and heterologous signal sequences," Virology, vol. 204, No. 1, pp. 266-278 (Oct. 1994).
Liao, H.-X., et al., "Antigenicity and Immunogenicity of Transmitted/Founder, Consensus, and Chronic Envelope Glycoproteins of Human Immunodeficiency Virus Type 1," Journal of Virology, vol. 87, No. 8, pp. 4185-4201, with Supplementary Materials—34 total pages (Apr. 2013).
McCune, J.M., et al., "Endoproteolytic Cleavage of gp160 Is Required for the Activation of Human Immunodeficiency Virus," Cell, vol. 53, pp. 55-67 (Apr. 8, 1988).
McKeating, J.A. and Willey, R.L., "Structure and function of the HIV envelope," AIDS, vol. 3, Suppl. 1, pp. S35-S41 (1989).

\* cited by examiner

Figure 1

```
>CH0848.3.d0135.27.03
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLRGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0107.30.12
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISANSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0107.30.31
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWSKTLQ
EVGKELQKHFPNKTIKYERSAGGDMEIATHSFNCGGEFFYCNTSNLFNGT
YNGTYISANSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
```

Figure 1 continued

```
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0078.30.42
MRVMGILKNYPQWWIWGILGFWMLMICNGKGNLWVTVYYGVPVWKEAKTT
LFCASNAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0135.60.14
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGHITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0135.60.05
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
```

Figure 1 continued

```
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0135.60.19
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEGIQRFCRAI
RNIPTRIRQGFEASLL*
>CH0848.3.d0107.30.27
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0078.30.02
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
```

Figure 1 continued

```
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTHSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRLFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEVIQRFCRAI
RNIPTRIRQGFEASLL*
>CH0848.3.d0135.60.34
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEEIQRFCRAI
RNIPTRIRQGFEASLL*
>CH0848.3.d0135.60.32
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEGQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGR
EVLKYLGSLVQYWGLELKKSAISLFDTIAIAVAEGTDRIIEGIQRFCRAI
RNIPTRIRQGFEASLL*
>CH0848.3.d0135.60.20
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
```

Figure 1 continued

```
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSNSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEGIQRFCRAI
RNIPTRIRQGFEASLL*
>CH0848.3.d0194.25.21
MKVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSTSSITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTDVPWNTSWSNKSEKDIWDNMTWMQWEREISNYTETIYMLLE
DSQHQQERNEKDLLALDSWNSLWNWFNITNWLWYIRIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEGIQRFCRAI
RNIPTRIRQGFEASLL*
>CH0848.3.d0194.25.24
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNNSWSNKSEKDIWDNMTWMQWEREISNYTETIYMLLE
DSQHQQERNEKDLLALDSWNSLWNWFNITNWLWYIKIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEGIQRFCRAI
RNIPTRIRQGFEASLL*
>CH0848.3.d0194.25.17
```

Figure 1 continued

```
MRVMGILKNYPQWWIWGILGFWMLMICNGKGNLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSSTNSTSNITLQCRIKQIINMWQGVGRAMYAPPIAGNITCK
SNITGLLLTRDGGTKNNSNETEETFRPAGGDMRDNWRSELYKYKVVEIQP
LGIAPTGAKRRVVEREKRAAGLGALFLGFLGAAGSTMGAASITLTVQARQ
LLSGIVQQQSNLLRAIEAQQHMLQLTVWGIKQLQARVLALERYLKDQQLL
GMWGCSGKLICTTAVPWNASWSNKSEKDIWDNMTWMQWEREISNYTETIY
MLLEDSQHQQERNEKDLLALDSWNSLWNWFNITNWLWYIRIFIMIVGGLI
GLRIVFAVLSIVNRVRQGYSPLSLQTLTPNPREPDRLGGIEEEGGEQDRD
RSIRLVNGFLPIVWDDLRSLCLFSYHRLRDFLLLAARVVELLGRSSLRGL
QRGWEVLKYLGSLVQYWGLELKKSAISLFDTIAIAVAEGTDRIIEGIQRF
CRAIRNIPTRIRQGFEASLL*
>CH0848.3.d0274.30.09
MRVRGILKNYPQWWIWGILGFWMLMICNGKGKLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLNCSNATVNSSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTPV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSSTNSTSNITLQCRIKQIINMWQGVGRAMYAPPIAGNITCK
SNITGLLLTRDGGTKNNSNETEETFRPAGGDMRDNWRSELYKYKVVEIQP
LGIAPTGAKRRVVEREKRAAGLGALFLGFLGAAGSTMGAASITLTVQARQ
LLSGIVQQQSNLLRAIEAQQHMLQLTVWGIKQLQARVLALERYLKDQQLL
GMWGCSGKLICTTTVPWNASWSNKSEKDIWDNMTWMQWEREISNYTETIY
MLLEDSQRQQERNEKDLLALDSWNSLWNWFNITNWLWYIRIFIMIVGGLI
GLRIVFAVLSIVNRVRQGYSPLSLQTLTPNPREPDRLGGIEEEGGEQDRD
RSIRLVSGFLPIVWDDLRSLCLFSYHRLRDFLLLAARVVELLGRSSLRGL
QRGWEVLKYLGSLVQYWGLELKKSAISLFDTIAIAVAEGTDRIIEGIQRF
CRAIRNIPTRIRQGFEASLL*
>CH0848.3.d0194.25.48
MRVMGIPKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNAIVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLQ
EVGKELQKHFPNKTIKYERSAGGDMEIATHSFNCGGEFFYCNTSNLFNGT
YNGTYINTSSTNITLQCRIKQIINMWQGVGRAMYAPPIAGNITCKSNIT
GLLLTRDGGTKNNSNETEETFRPAGGDMRDNWRSELYKYKVVEIQPLGIA
PTGARRRVVEREKRAAGLGALFLGFLGAAGSTMGAASITLTVQARQLLSG
IVQQQSNLLRAIEAQQHMLQLTIWGIKQLQARVLALERYLKDQQLLGMWG
CSGKLICTTAVPWNTSWSNKSEKDIWDNMTWMQWEREISNYTETIYTLLE
DSQHQQERNEKDLLALDSWNSLWNWFNITNWLWYIRIFIMIVGGLIGLRI
VFAVLSIVNRVRQGYSPLSLQTLTPNPREPDRLGGIEEGGEQDRDRSIR
LVSGFLPIVWDDLRSLCLFSYHRLRDFLLLAARVVELLGRSSLRGLQRGW
```

Figure 1 continued

```
EVLKYLGSLVQYWGLELKKSAISLFDTIAIAVAEGTDRIIEGIQRFCRAI
RNIPTRIRQGFEASLL*
>CH0848.3.d0135.27.06
MRVMGILKNYPQWWIWGILGFWMLMICNGKGKLWVTVYYGVPVWKEAKTT
LFCASDAKAYEKEVHNVWATHACVPTDPSPQELGLENVTENFNMWKNDMV
DQMHEDIISLWDQSLKPCVKLTPLCVTLKCSNAIVDSSKVYDTRSKVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKGIVIRSENLTNNAKIIIVQLNTSV
EIVCTRPGNNTRKSVRIGPGQTFYATGDIIGDIRQAHCNISEWQWNKTLH
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWDTNWSNKSEKDIWDNMTWMQWEREISNYTETIYKLLE
DSQHQQERNEQDLLALDSWNSLWNWFNITNWLWYIKIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFNTIAIAVAEGTDRIIEGIQRFCRAI
RNIPTRIRQGFEASLL*
>CH0848.3.d0274.30.02
MRVMGILKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCSNATVNSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLH
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNSSWSNKSEKDIWDNMTWMQWEREISNYTETIYKLLE
DSQHQQERNEQDLLALDSWNSLWNWFNITNWLWYIKIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIELIQRFCRAI
RNIPTRIRQGFEASLL*
>CH0848.3.d0274.30.07
MRVMGIPKNYPQWWIWGILGFWILMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCNSATVDNSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNDKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEGQWNKTLH
EVSKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYTLLE
```

Figure 1 continued

```
DSQHQQERNEKDLLALDSWNSLWNWFNITNWLWYIKIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRIIEGIQRFCRAI
RNIPTRIRQGFEASLL*
>CH0848.3.d0358.80.06
MRVMGIPKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNKTFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEGQWNKTLHEVSKELQKHF
PNKTIKYERSAGGDMEIATHSFNCGGEFFYCNTSNLFNGTYNGTYINTSS
TSYITLQCRIKQIINMWQGVGRAMYAPPIAGNITCKSNITGLLLTRDGGT
KNNSNEETFRPAGGDMRDNWRSELYKYKVVEIQPLGIAPTGAKRRVVERE
KRAAGLGALFLGFLGAAGSTMGAASITLTVQARQLLSGIVQQQSNLLRAI
EAQQHMLQLTVWGIKQLQARVLALERYLKDQQLLGMWGCSGKLICTTTVP
WNTSWSNKSEKDIWDNMTWMQWEREISNYTETIYTLLEDSQRQQERNEKD
LLALDSWNSLWNWFNITNWLWYIKIFIMIVGGLIGLRIVFAVLSIVNRVR
QGYSPLSLQTLTPNPREPDRLGGIEEEGGEQDRDRSIRLVSGFLPIVWDD
LRSLCLFSYHRLRDFLLLAARVVELLGRSSLRGLQRGWEVLKYLGSLVQY
WGLELKKSAISLFNTIAIAVAEGTDRIIKVIQRFCRAIRNIPTRIRQGFE
ASLL*
>CH0848.3.d0274.30.14
MRVMGILKNYLQWWIWGILGFWMLMICKGKGNLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLTCSNATVDNSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWYKTLQ
EVGKELQKHFPNKTIKYERSAGGDMEIATHSFNCGGEFFYCNTSNLFNGT
YNGTYISINSTSYITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTAVPWNTSWSNKSEKDIWDNMTWMQWEREISNYTETIYTLLE
DSQHQQERNEKDLLALDSWNSLWNWFNITNWLWYIKIFIMIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRILEVIQRFCRAI
RNIPTRIRQGFEASLL*
>CH0848.3.d0358.80.44
MRVMGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNKTFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEEKWNKTLQEVGKELQKHF
PNKTIKYERSAGGDMEIATHSFNCGGEFFYCNTSNLFNGTYNGTDISTNS
NSTITLQCRIKQIINMWQGVGRAMYAPPIAGNITCKSNITGLLLTRDGGT
KNNSNEETFRPAGGDMRDNWRSELYKYKVVEIQPLGIAPTGAKRRVVERE
```

Figure 1 continued

```
KRAAGLGALFLGFLGAAGSTMGAASITLTVQARQLLSGIVQQQSNLLRAI
EAQQHMLQLTVWGIKQLQARVLALERYLKDQQLLGMWGCSGKLICTTTVP
WNASWSNKSEKDIWDNMTWMQWEREISNYTETIYMLLEDSQRQQERNEKD
LLALDSWNSLWNWFNITNWLWYIKIFIMIVGGLIGLRIVFAVLSIVNRVR
QGYSPLSLQTLTPNPREPDRLGGIEEEGGEQDRDRSIRLVSGFLPIVWDD
LRSLCLFSYHRLRDFLLLAARVVELLGRSSLRGLQRGWEVLKYLGSLVQY
WGLELKKSAISLFNTIAIAVAEGTDRIIEGIQRFCRAIRNIPTRIRQGFE
ASLL*
>CH0848.3.d0358.80.03
MKVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNETFNGTGPCSNVSTVQCTHGIR
PVVSTQLLLNGSLAEKEIVIRSENLTNNAKIIIVHLNTPVEIVCTRPGNN
TRKSVRIGPGQTFYATGDIIGDIRQAHCNISEGQWNKTLQEVGKELQKHF
PNKTIKYERSAGGDMEITTHSFNCGGEFFYCNTSNLFNGTYNGTYINIST
NSNSTITLQCRIKQIINMWQGVGRAMYAPPIAGNITCKSNITGLLLTRDG
GTKNNSNEETFRPAGGDMRDNWRSELYKYKVVEIQPLGIAPTGAKRRVVE
REKRAAGLGALFLGFLGAAGSTMGAASITLTVQARQLLSGIVQQQSNLLR
AIEAQQHMLQLTVWGIKQLQARVLALERYLKDQQLLGMWGCSGKLICTTA
VAWNTSWSNKSEKDIWDNMTWMQWEREISNYTETIYTLLEDSQRQQERNE
KDLLALDSWNSLWNWFNITNWLWYIKIFIMIVGGLIGLRIVFAVLSIVNR
VRQGYSPLSLQTLTPNPREPDRLGGIEEEGGEQDRDRSIRLVSGFLPIVW
DDLRSLCLFSYHRLRDFLLLAARVVELLRRSSLRGLQRGWEVLKYLGSLV
QYWGLELKKSAISLLDTIAIAVAEGTDRIIEVIQRSCRAIRNIPTRIRQG
FEASLL*
>CH0848.3.d0358.80.17
MRVMGILKNYPQWWIWGILGFWMLMNCNGKGNLWVTVYYGVPVWKEAKTT
LFCASDAKAYKKEVHNVWATHACVPTDPSPQELVLENVTENFNMWKNDMV
DQMHEDIISLWDQSLKPCVKLTPLCVTLNCSNARSNVNVTSINNTIMGEM
KNCSFNTTTEIRDKEKKEYALFYRPDVVPLNETSNTSEYRLINCNTSAVT
QACPKVTFEPIPIHYCAPAGYAILKCNNETFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEEKWNKTLQQVGKELQKHF
PNKTIKYERSAGGDMEITTHSFNCGGEFFYCNTSNLFNGTYNGTYINIST
NSNSTITLQCRIKQIINMWQGVGRAMYAPPIAGNITCKSNITGLLLTRDG
GTKNNSNEETFRPAGGDMRDNWRSELYKYKVVEIQPLGIAPTGAKRRVVE
REKRAAGLGALFLGFLGAAGSTMGAASITLTVQARQLLSGIVQQQSNLLR
AIEAQQHMLQLTVWGIKQLQARVLALERYLKDQQLLGMWGCSGKLICTTA
VAWNTSWSNKSEKDIWDNMTWMQWEREISNYTETIYTLLEDSQRQQERNE
KDLLALDSWNSLWNWFNITNWLWYIKIFIMIVGGLIGLRIVFAVLSIVNR
VRQGYSPLSLQTLTPNPREPDRLGGIEEEGGEQDRDRSIRLVSGFLPIVW
DDLRSLCLFSYHRLRDFLLLAARVVELLGRSSLRGLQRGWEVLKYLGSLV
QYWGLELKKSAISLLDTIAIAVAEGTDRIIEVIQRSCRAIRNIPTRIRQG
FEASLL*
>CH0848.3.d0445.30.41
MRVMGILKNYPQWWIWGILGFWMLMICKGKGNLWVTVYYGVPVWKEAKTT
LFCASDAKAYEKEMHNVWATHACVPTDPSPQELFLENVTENFNMWKNDMV
DQMHEDIISLWDQSLKPCVKLTPLCVTLNCSNVSNVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLNTSVEIVCTRPGNNT
RKSVRIGPGQTFYATGDIIGDIRQAHCNISEEKWNKTLQQVGKELQKHFP
```

Figure 1 continued

```
NKTIKYERSAGGDMEIATHSFNCGGEFFYCNTSNLFNGTYNGTYSTNSTS
TITLQCRIKQIINMWQGVGRAMYAPPIAGNITCKSNITGLLLTRDGGTKN
NSNEETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICNTAVAWN
TSWSNKSEKDIWDNMTWMQWEREISNYTETIYTLLEDSQRQQERNEKDLL
ALDSWNSLWNWFNITNWLWYIKIFIMIVGGLIGLRIVFAVLSIVNRVRQG
YSPLSLQTLTPNPREPDRLGGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIEVIQGFCRAIRNIPTRIRQGFEAS
LL*
>CH0848.3.d0445.25.04
MRVMGIPKNYPQWWIWGILGFWMLMNCNGKGNLWVTVYYGVPVWKEAKTT
LFCASDAKAYKKEVHNVWATHACVPTDPSPQELVLDNVTENFNMWKNDMV
DQMHEDIISLWDQSLKPCVKLTPLCVTLNCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKGIVIRSENLTNNAKIIIVQLNTSVEIVCTRPGNNT
RKSVRIGPGQTFYATGDIIGDIRQAHCNISEEKWNKTLHEVSKELQKHFP
NKTIKYERSAGGDMEIATHSFNCGGEFFYCNTSKLFNGTYNGTYISTNST
SYITLQCRIKQIINMWQGVGRAMYAPPIAGNITCKSNITGLLLTRDGGTN
NNSNEETFRPAGGDMRDNWRSELYKYKVVEIQPLGIAPTGAKRRVVEREK
RAAGLGALFLGFLGAAGSTMGAASITLTVQARQLLSGIVQQQSNLLRAIE
AQQHMLQLTVWGIKQLQARVLALERYLKDQQLLGMWGCSGKLICTTAVAW
NTSWSNKSEKDIWDNMTWMQWEREISNYTETIYTLLEDSQRQQERNEKDL
LALDSWNSLWNWFNITNWLWYIKIFIMIVGGLIGLRIVFAVLSIVNRVRQ
GYSPLSLQTLTPNPREPDRLGGIEEEGGEQDRDRSIRLVSGFLPIVWDDL
RSLCLFSYHRLRDFLLLAARVVELLGRSSLRGLQRGWEVLKYLGSLVQYW
GLELKKSAISLLDTIAIAVAEGTDRIIEVIQGFCRAIRNIPTRIRQGFEA
SLL*
>CH0848.3.d0445.30.42
MRVMGILKNYPPWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLNCSNVNVVNVTNITNTIKGEMK
NCSFNTTTEIRDKEKKEYALFYKPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLNTSVEIVCTRPGNNT
RKSVRIGPGQTFYATGDIIGDIRQAHCNISEEKWNKTLHEVSKELQKHFP
NKTIKYERSAGGDMEIATHSFNCGGEFFYCNTSNLFNGTYNGTYISTNSS
ANSNSTITLQCRIKQIINMWQGVGRAMYAPPIAGNITCKSNITGLLLTRD
GGTKNNSNEETFRPAGGDMRDNWRSELYKYKVVEIQPLGIAPTGAKRRVV
EREKRAAGLGALFLGFLGAAGSTMGAASITLTVQARQLLSGIVQQQSNLL
RAIEAQQHMLQLTVWGIKQLQARVLALERYLKDQQLLGMWGCSGKLICTT
AVAWNTSWSNKSEKDIWDNMTWMQWEREISNYTETIYTLLEDSQRQQERN
EKDLLALDSWNSLWNWFNITNWLWYIKIFIMIVGGLIGLRIVFAVLSIVN
RVRQGYSPLSLQTLTPNPREPDRLGGIEEEGGEQDRDRSIRLVSGFLPIV
WDDLRSLCLFSYHRLRDFLLLAARVVELLGRSSLRGLQRGWEVLKYLGSL
VQYWGLELKKSAISLLDTIAIAVAEGTDRIIEVIQGFCRAIRNIPTRIRQ
GFEASLL*
>CH0848.3.d0445.25.26
MRVMGILKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLDCSNVNVVNVTNITNTIKGEMK
NCSFNTTTEIRDKEKKEYALFYRPDVVPLNETSNTSEYRLINCNTSAVTQ
```

Figure 1 continued

ACPKVTFEPIPIHYCAPAGYAILKCNNETFNGTGPCSNVSTVQCTHGIRP
VVSTQLLLNGSLAEKEIVIRSENLTNNAKIIIVHLNTPVEIVCTRPGNNT
RKSVRIGPGQTFYATGDIIGDIRQAHCNISEKQWNETLQKVGKELQKHFP
NKTIKYERSAGGDMEITTHSFNCGGEFFYCNTSNLFNGTYNGTYINISTN
SNSTITLQCRIKQIINMWQGVGRAMYAPPIAGNITCRSNITGLLLTRDGG
TKNNSNEETFRPAGGDMRDNWRSELYKYKVVEIQPLGIAPTGAKRRVVER
EKRAAGLGALFLGFLGAAGSTMGAASITLTVQARQLLSGIVQQQSNLLRA
IEAQQHMLQLTVWGIKQLQARVLALERYLKDQQLLGMWGCSGKLICTTAV
PWNSSWSNKSEKDIWDNMTWMQWEREISNYTETIYTLLEDSQRQQERNEK
DLLALDSWNSLWNWFNITKWLWYIKIFIMIVGGLIGLRIVFAVLSIVNRV
RQGYSPLSLQTLTPNPREPDRLGGIEEEGGEQDRDRSIRLVSGFLPIVWD
DLRSLCLFSYHRLRDFLLLAARVVELLGRSSLRGLQRGWEVLKYLGSLVQ
YWGLELKKSAISLFDTLAIAVAEGTDRIIEIIQGFCRAIRNIPTRIRQGF
EASLL*
>CH0848.3.d0526.25.21
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLNCVNVTNITNTIKGEMKNCSFN
TTTEIRDKEKKEYALFYRPDVVPLNETSNTSEYRLINCNTSAVTQACPKV
TFEPIPIHYCAPAGYAILKCNNETFNGTGPCSNVSTVQCTHGIRPVVSTQ
LLLNGSLAEKGIVIRSENLTNNAKIIIVQLNTSVEIVCTRPGNNTRKSVR
IGPGQTFYATGDIIGDIRQAHCNISEEKWNKTLQQVGKELQKHFPNKTIK
YERSAGGDMEITTHSFNCGGEFFYCNTSNLFNGTYNGTYNGTNSNSTITL
QCRIKQIINMWQGVGRAMYAPPIAGNITCRSNITGLLLTRDGGTNSNKTE
ETFRPAGGDMRDNWRSELYKYKVVEIQPLGIAPTGAKRRVVEREKRAAGL
GALFLGFLGAAGSTMGAASITLTVQARQLLSGIVQQQSNLLRAIEAQQHM
LQLTVWGIKQLQARVLALERYLKDQQLLGMWGCSGKLICTTNVPWNTSWS
NKSEKDIWDNMTWMQWEREISNYTETIYTLLEDSQRQQERNEKDLLALDS
WNSLWNWFNITNWLWYIKIFIMIVGGLIGLRIVFAVLSIVNRVRQGYSPL
SLQTLTPNPREPDRLGGIEEEGGEQDRDRSIRLVSGFLPIVWDDLRSLCL
FSYHRLRDFLLLAARVVELLGRSSLRGLQRGWEVLKYLGSLVQYWGLELK
KSAISLFDTIAIAVAEGTDRILEVIQRFCRAIRNIPTRIRQGFEASLL*

>CH0848.3.d0526.25.10
MRVMGIPKNYPQWWIWGILGFWMLMNCNGKGNLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLNCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLHTPVEIVCTRPGNNT
RKSVRIGPGQTFYATGDIIGDIRQAHCNISEEKWNKTLQQVGKELQKHFP
NKTIKYERSAGGDMEITTHSFNCGGEFFYCNTSNLFNGTYNGKYINISTN
SNSTITLQCRIKQIINMWQGVGRAMYAPPIAGNITCKSNITGLLLTRDGG
TKNNSTETEETFRPAGGDMRDNWRSELYKYKVVEIQPLGIAPTGAKRRVV
EREKRAAGLGALFLGFLGAAGSTMGAASITLTVQARQLLSGIVQQQSNLL
RAIEAQQHMLQLTVWGIKQLQARVLALERYLKDQQLLGMWGCSGKLICTT
DVPWNTSWSNKSEKDIWDNMTWMQWEREISNYTETIYTLLEDSQRQQERN
EKDLLALDSWNSLWNWFNITNWLWYIKIFIMIVGGLIGLRIVFAVLSIVN
RVRQGYSPLSLQTLTPNPREPDRLRGIEEEGGEQDRDRSIRLVSGFLPIV
WDDLRSLCLFSYHRLRDFLLLAARVVELLGRSSLRGLQRGWEVLKYLGSL
VQYWGLELKKSAISLFDTIAIAVAEGTDRILEVIQRFCRAIRNIPTRIRQ
GFEASLL*
>CH0848.3.d0445.25.18
MRVMGIPKNYPQWWIWGILGFWMLMNCNGKENLWVTVYYGVPVWKEAKTT

Figure 1 continued

```
LFCASDAKAYKKEVHNVWATHACVPTDPSPQELVLKNVTENFNMWKNDMV
DQMHEDIISLWDQSLKPCVKLTPLCVTLNCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLHTPVEIVCTRPGNNT
RKSVRIGPGQTFYATGDIIGDIRQAHCNISEEKWNKTLQEVGKELQKHFP
NKTIKYERSAGGDMEITTHSFNCGGEFFYCNTSNLFNGTYNGPYINISTN
SNSTITLQCRIKQIINMWQGVGRAMYAPPIAGNITCKSNITGLLLTRDGG
TKNNSNEETFRPAGGDMRDNWRSELYKYKVVEIQPLGIAPTGAKRRVVER
EKRAAGLGALFLGFLGAAGSTMGAASITLTVQARQLLSGIVQQQSNLLRA
IEAQQHMLQLTVWGIKQLQARVLALERYLKDQQLLGMWGCSGKLICTTAV
AWNTSWSNKSEKDIWDNMTWMQWEREISNYTETIYTLLEDSQRQQERNEK
DLLALDSWNSLWNWFNITNWLWYIKIFIMIVGGLIGLRIVFAVLSIVNRV
RQGYSPLSLQTLTPNPREPDRLGGIEEEGGEQDRDRSIRLVSGFLPIVWD
DLRSLCLFSYHRLRDFLLLAARVVELLGRSSLRGLQRGWEVLKYLGSLVQ
YWGLELKKSAISLFDTLAIAVAEGTDRIIEVIQGFCRAIRNIPTRIRQGF
EASLL*
>CH0848.3.d0526.25.02
MKVMGILKNYPQWWIWGILGFWMLMICKGKGNLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLICSNATVNNRTAYDTRSNVNVT
SINNTIMGEMKNCSFNTTTEIRDKEKKEYALFYKPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNETLQ
KVGKELQKHFPNKTIKYERSAGGDMEIATHSFNCGGEFFYCNTSKLFNGT
YNGTDINISTNSNSTITLQCRIKQIINMWQGVGRAMYAPPIAGNITCKSN
ITGLLLTRDGGTNSNKTEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTNVPWNTSWSNKSEKDIWDNMTWMQWEREISNYTETIYMLLE
DSQRQQERNEKDLLALDSWNSLWNWFNITNWLWYIKIFIMIVGGLIGLRI
VFAVLSIVNRVRQGYSPLSLQTLTPNPREPDRLGGIEEEGGEQDRNRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRILEVIQRFCRAI
RNIPTRIRQGFEASLL*
>CH0848.3.d0526.25.26
TRVMGILKNYPQWWIWGILGFWMLMICNGKGNLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLNCSNVNVTRSNVNVTNITNTIK
GEMKNCSFNTTTEIRDKEKKEYALFYRSDVVPLNETSNTSEYRLINCNTS
AVTQACPKVTFEPIPIHYCAPAGYAILKCNNETFNGTGPCSNVSTVQCTH
GIRPVVSTQLLLNGSLAEKEIVIRSENLTNNAKIIIVHLHTPVEIVCTRP
GNNTRKSVRIGPGQTFYATGDIIGDIRQAHCNISEEKWNKTLHEVSKELQ
KHFPNKTIKYAQSAGGDMEITTHSFNCGGEFFYCNTSNLFNGTYNGTYIS
TNSSANSNSTITLQCRIKQIINMWQGVGRAMYAPPIAGNITCRSNITGLL
LTRDGGTKNNKTEETFRPAGGDMRDNWRSELYKYKVVEIQPLGIAPTGAK
RRVVEREKRAAGLGALFLGFLGAAGSTMGAASITLTVQARQLLSGIVQQQ
SNLLRAIEAQQHMLQLTVWGIKQLQARVLALERYLKDQQLLGMWGCSGKL
ICTTNVPWNTSWSNKSEKDIWDNMTWMQWEREISNYTETIYMLLEDSQRQ
QERNEKDLLALDSWNSLWNWFNITNWLWYIKIFIMIVGGLIGLRIVFAVL
SIVNRVRQGYSPLSLRTLTPNPREPDRLGGIEEEGGEQDRDRSIRLVSGF
LPIVWDDLRSLCLFSYHRLRDFLLLAARVVELLGRSSLRGLQRGWEVLKY
LGSLVQYWGLELKKSAISLFDTIAIAVAEGTDRILEVIQRFCRAIRNIPT
```

Figure 1 continued

```
RIRQGFEASLL*
>CH0848.3.d0526.25.09
MRVMGILKNYPQWWIWGILGFWMLMICNGKGKLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLNCSNVNVTGSNVNVTNITNTIT
GEMKNCSFNTTTEIRDKEKKEYALFYKPDVVPLNETSNTSEYRLINCNTS
AVTQACPKVTFEPIPIHYCAPAGYAILKCNNETFNGTGPCSNVSTVQCTH
GIRPVVSTQLLLNGSLAEKGIVIRSENLTNNAKIIIVQLNTSVEIVCTRP
GNNTRKSVRIGPGQTFYATGGIIGDIRQAHCNISESKWNETLHEVSKELQ
KHFPNKTIKYERSAGGDMEITTHSFNCGGEFFYCNTSNLFNGTYNGTYNG
TNSNSTITLQCRIKQIINMWQGVGRAMYAPPIAGNITCRSNITGLLLTRD
GGTNSNKTEETFRPAGGDMRDNWRSELYKYKVVEIQPLGIAPTGAKRRVV
EREKRAAGLGALFLGFLGAAGSTMGAASITLTVQARQLLSGIVQQQSNLL
RAIEAQQHMLQLTVWGIKQLQARVLALERYLKDQQLLGMWGCSGKLICTT
NVPWNTSWSNKSEKDIWDNMTWMQWEREISNYTETIYTLLEDSQRQQERN
EKDLLALDSWNSLWNWFNITNWLWYIKIFIMIVGGLIGLRIVFAVLSIVN
RVRQGYSPLSLQTLTPNPREPDRLGGIEEEGGEQDRDRSIRLVSGFLPIV
WDDLRSLCLFSYHRLRDFLLLAARVVELLGRSSLRGLQRGWEVLKYLGSL
VQYWGLELKKSAISLFDTIAIAVAEGTDRILEVIQRFCRAIRNIPTRIRQ
GFEASLL*
>CH0848.3.d0526.25.39
MRVMGIPKNYPQWWIWGILGFWMLMICSGRGNLWVTVYYGVPVWKEAKTT
LFCASDAKAYEKEMHNVWATHACVPTDPSPQELFLENVTENFNMWKNDMV
DQMHEDIISLWDQSLKPCVKLTPLCVTLICSNATVNNRTVYDTRSNVNVT
SINNTIMGEMKNCSFNTTTEIRDKEKKEYALFYKPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTPV
EIVCTRPGNNTRKSVRIGPGQTFYATGDIIGDIRQAHCNISEEKWNKTLQ
KVGKELQKHFPNKTIKYERSAGGDMEITTHSFNCGGEFFYCNTSKLFNGT
YNGINISTNSNSTITLQCRIKQIINMWQGVGRAMYAPPIAGNITCKSNIT
GLLLTRDGGNRNNSNEETFRPAGGDMRDNWRSELYKYKVVEIQPLGIAPT
GAKRRVVEREKRAAGLGALFLGFLGAAGSTMGAASITLTVQARQLLSGIV
QQQSNLLRAIEAQQHMLQLTVWGIKQLQARVLALERYLKDQQLLGMWGCS
GKLICTTNVPWNTSWSNKSEKDIWDNMTWMQWEREISNYTETIYMLLEDS
QRQQERNEKDLLALDSWNSLWNWFNITNWLWYIKIFIMIVGGLIGLRIVF
AVLSIVNRVRQGYSPLSLQTLTPNPREPDRLGGIEEEGGEQDRDRSIRLV
SGFLPIVWDDLRSLCLFSYHRLRDFLLLAARVVELLGRSSLRGLQRGWEV
LKYLGSLVQYWGLELKKSAISLFDTIAIAVAEGTDRILEVIQRFCRAIRN
IPTRIRQGFEASLL*
>CH0848.3.d0526.25.32
MRVMGIPKNYPQWWIWGILGFWMLMNCNGKENLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLICSNATVNNRTVYDTRSNANVT
SINNTIMGEMKNCSFNTTTEIRDKEKKEYALFYRPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLHTPV
EIVCTRPGNNTRKSVRIGPGQTFYATGDIIGDIRQAHCNISEEKWNKTLQ
KVGKELQKHFPNKTIKYERSAGGDMEITTHSFNCGGEFFYCNTSNLFNGT
YNGTYNGTNSNSTITLQCRIKQIINMWQGVGRAMYAPPIAGNITCRSNIT
GLLLTRDGGTNSNKTEETFRPAGGDMRDNWRSELYKYKVVEIQPLGIAPT
GAKRRVVEREKRAAGLGALFLGFLGAAGSTMGAASITLTVQARQLLSGIV
QQQSNLLRAIEAQQHMLQLTVWGIKQLQARVLALERYLKDQQLLGMWGCS
GKLICTTTVAWNTSWSNKSEKDIWDNMTWMQWEREISNYTETIYTLLEDS
QRQQERNEKDLLALDSWNSLWNWFNITNWLWYIKIFIMIVGGLIGLRIVF
```

Figure 1 continued

```
AVLSIVNRVRQGYSPLSLQTLTPNPREPDRLGGIEEEGGEQDRDRSIRLV
SGFLPIVWDDLRSLCLFSYHRLRDFLLLAARVVELLGRSSLRGLQRGWEV
LKYLGSLVQYWGLELKKSAISLFDTIAIAVAEGTDRILEVIQGFCRAIRN
IPTRIRQGFEASLL*
>CH0848.3.d0526.25.11
MRVMGILKNCPQWWIWGILGFWMLMICNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLICSNATVNNRTVYDTRSNVSVT
SINNTIMGEMKNCSFNTTTEIRDKEKKEYALFYRPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTPV
EIVCTRPSNNTRKSVRIGPGQTFYATGDIIGDIRQAHCNISEEKWNKTLQ
KVGKELQKHFPNKTIKYERSAGGDMEITTHSFNCGGEFFYCNTSNLFNGT
YNGTYTNISTNSNSTITLQCRIKQIINMWQGVGRAMYAPPIAGNITCRSN
ITGLLLTRDGGTNSNKTEETFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTNVPWNTSWSNKSEKDIWDNMTWMQWEREISNYTETIYTLLE
DSQRQQERNEKDLLALDSWNSLWNWFNITNWLWYIKIFIMIVGGLICLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTLAIAVAEGTDRIIEVIQGFCRAI
RNIPTRIRQGFEASLL*
>CH0848.3.d0611.20.12
MRVMGIPKNYPQWWIWGILGFWMLMNCNGKGNLWVTVYYGVPVWKEAKTT
LFCASDAKAYKKEVHNVWATHACVPTDPSPQELFLENVTENFNMWKNDMV
DQMHEDIISLWDQSLKPCVKLTPLCVTLICSNATVNNRTMGEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPGNNTRKSVRI
GPGQTFYATGAIIGDIRQAHCNISESKWNETLQKVGKELQKHFPNKTIKY
EQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKRAAGL
GALFLGFLGAAGSTMGAASITLTVQARQLLSGIVQQQSNLLRAIEAQQHM
LQLTVWGIKQLQARVLALERYLKDQQLLGMWGCSGKLICTTNVPWNTSWS
NKSEKDIWDNMTWMQWEREISNYTETIYMLLEDSQRQQERNEKDLLALDS
WNSLWNWFNITNWLWYIKIFIMIVGGLIGLRIVFAVLSIVNRVRQGYSPL
SLQTLTPNPREPDRLGGIEEEGGEQDRDRSIRLVSGFLPIVWDDLRSLCL
FSYHRLRDFLLLAARVVELLGRSSLRGLQRGWEVLKYLGSLVQYWGLELK
KSAISLFDTIAIAVAEGTDRILEVIQRFCRAIRNIPTRIRQGFEASLL*

>CH0848.3.d0700.27.06
MRVMGILKNYPQWWIWGILGFWMLMICKGKGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSNATVNNRTVYEMKNCSFNT
TTEIRDKEKKEYALFYRSDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLHTPVEIVCTRPGNNTRKSVRI
GPGQTFYATGDIIGEIRQAHCNISESKWNETLQKVGKELQKHFPNKTIKY
ERSAGGDMEITTHSFNCGGEFFYCNTSKLFNGTYNGTDISTNSSANSNST
ITLQCRIKQIINIWQGVGRAMYAPPIAGNITCKSNITGLLLTRDGGNNNN
RNEETFRPAGGDMRDNWRSELYKYKVVEIQPLGIAPTGAKRRVVEREKRA
AGLGALFLGFLGAAGSTMGAASITLTVQARQLLSGIVQQQSNLLRAIEAQ
```

Figure 1 continued

```
QHMLQLTVWGIKQLQARVLALERYLKDQQLLGMWGCSGKLICTTNVPWNT
SWSNKSEKDIWDNMTWMQWEREISNYTETIYMLLEDSQRQQERNEKDLLA
LDSWNSLWNWFNITNWLWYIKIFIMIVGGLIGLRIVFAVLSIVNRVRQGY
SPLSLQTLTPNPREPDRLRGIEEEGGEQDRDRSIRLVSGFLPIVWDDLRS
LCLFSYHRLRDFLLLAARVVELLGRSSLRGLQRGWEVLKYLGSLVQYWGL
ELKKSAISLFDTLAIAVAEGTDRIIEVIQGFCRAIRNIPTRIRQGFEASL
L*
>CH0848.3.d1305.10.30
MRVTGILKNYPQWWIWGILGFWMLMTCNGEGNLWVTVYYGVPVWKEAKTT
LFCASDAKAYKKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVPLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPGHNTRKSVRI
GPGQTFYATGDIIGDIRQAHCNINESEWNETLQKVGKELQKHFPNKTIKY
EQSAGGDMEITTHSFNCGGEFFYCNTAELFNGTYNGTDISTNSSANSTST
ITLQCRIKQIINMWQGVGRAMYAPPIAGNITCRSNITGLLLTRDGGINNV
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSEMDIWNNMTWMQWEREISNYTETIYMLLEDSQRQQERNEKDLL
ALDSWNSLWNWFNITNWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGHSSLRGLQRGWEVLKYLGSLVQYWG
LELKRSAISLFDTLAIAVAEGTDRIIELIQGFCRAIRNIPTRIRQGFEAS
LL*
>CH0848.3.d1432.5.50
MRVTGILKNYPQWWIWGILGFWMLMNCNGEGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVPLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPGHNTRKSVRI
GPGQTFYATGDIIGDIRQAHCNINESKWNETLQKVGNELQKHFPNKTIKY
EQAAGGDMEITTHSFNCGGEFFYCNTANLFNGTYNGTDISTNSSANSTST
ITLQCKIKQIINMWQGVGRAMYAPPIAGNITCRSNITGLLLTRDGGINNV
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSEMDIWNNMTWMQWEREISNYTETIYMLLEDSQRQQERNEKDLL
ALDSWNSLWNWFNITNWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGHSSLRGLQRGWEVLKYLGSLVQYWG
LELKKGAISLFDTLAITVAEGTDRIIEVIQGFCRAIRNIPTRIRQGFEAS
LL*
>CH0848.3.d1621.4.25
MRVTGILKNYPQWWIWGILGFWMLMNCNGEGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVSLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKTIIVHLHAPVEIVCTRPGHNTRKSVRI
GPGQTFYATGDIIGNIRQAHCNINESEWNETLQKVGKELRKHFPNKTIKY
EQSAGGDMEITTHSFNCGGEFFYCNTANLFNGTYNGTDISTNSSADRNST
```

Figure 1 continued

ITLECKIKQIINMWQGVGRAMYAPPIAGNITCRSNITGLLLTRDGGINNV
SNATETFRPAGGDMRDNWRSELYKYKVVEVQPLGIAPTGAKRRVVEREKR
AVGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSEMDIWNNMTWMQWEREISNYTETIYMLLEDSQRQQERNEKDLL
ALDSWNSLWNWFNITNWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGHSSLRGLQRGWEVLKYLGSLVQYWG
LELKRSTISLFDTLAIAVAEGTDRIIELIQGFCRAIRNIPTRIRQGFEAS
LL*
>CH0848.3.d0611.9.02
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLICSNATVNNRTVYEMKNCSFNT
TTEIRDKEKKEYALFYRPDIVPLGETSNTSEYRLINCNTSAVTQACPKVT
FEPIPIHYCAPAGYAILKCNNETFNGTGPCSNVSTVQCTHGIRPVVSTQL
LLNGSLAEKGIVIRSENLTNNAKIIIVHLHTPVEIVCTRPGNNTRKSVRI
GPGQTFYATGDIIGDIRQAHCNISEEKWNETLQKVGKELQKHFPNKTIKY
AQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKRAAGL
GALFLGFLGAAGSTMGAASITLTVQARQLLSGIVQQQSNLLRAIEAQQHM
LQLTVWGIKQLQARVLALERYLKDQQLLGMWGCSGKLICTTVVPWNTSWS
NKSEKDIWDNMTWMQWEREISNYTETIYKLLEDSQNQQERNEQDLLALDS
WNSLWNWFNITKWLWYIKIFIMIVGGLIGLRIVFAVLSIVNRVRQGYSPL
SLQTLTPNPREPDRLGGIEEEGGEQDRDRSIRLVSGFLPIVWDDLRSLCL
FSYHRLRDFLLLAARVVELLGRSSLRGLQRGWEVLKYLGSLVQYWGLELK
KSAISLFDTLAIAVAEGTDRIIEVIQGFCRAIRNIPTRIRQGFEASLL*

>CH0848.3.d0611.20.28
MRVMGILKNCPQWWIWGILGFWMLMICNGKGKLWVTVYYGVPVWKEAKTT
LFCASDARAYEKEVHNVWATHACVPTDPSPQELVLDNVTENFNMWKNDMV
DQMHEDIISLWDQSLKPCVKLTPLCVTLICSNATVNNRTVYEMKNCSFNT
TTEIRDKEKKEYALFYRPDIVPLNETSNTSEYRLINCNTSAVTQACPKVT
FEPIPIHYCAPAGYAILKCNNKTFNGTGPCSKVSTVQCTHGIRPVVSTQL
LLNGSLAEKEIVIRSENLTNNAKIIIVHLHTPVEIVCTRPGNNTRKSVRI
GPGQTFYATGDIIGDIRQAHCNISEEKWNETLQKVGKELQKHFPNKTIKY
AQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKRAAGL
GALFLGFLGAAGSTMGAASITLTVQARQLLSGIVQQQSNLLRAIEAQQHM
LQLTVWGIKQLQARVLALERYLKDQQLLGMWGCSGKLICTTNVPWNTSWS
NKSEKDIWDNMTWMQWEREISNYTETIYMLLEDSQRQQERNEKDLLALDS
WNSLWNWFNITNWLWYIKIFIMIVGGLIGLRIVFAVLSIVNRVRQGYSPL
SLQTLTPNPREPDRLRGIEEEGGEQDRDRSIRLVSGFLPIVWDDLRSLCL
FSYHRLRDFLLLAARVVELLGRSSLRGLQRGWEVLKYLGSLVQYWGLELK
KSAISLFDTLAIAVAEGTDRIIEGIQRFCRAIRNIPTRIRQGFEASLL*

>CH0848.3.d0611.20.14
MKVMGIPKNYPQWWIWGILGFWMLMNCNGKENLWVTVYYGVPVWKEAKTT
LFCASDAKAYKKEVHNVWATHACVPTDPSPQELVLGNVTENFNMWKNDMV
DQMHEDIISLWDQSLKPCVKLTPLCVTLICSNATVNNRTVYEMKNCSFNT
TTEIRDKEKKEYALFYRPDIVPLNETSNTSEYRLINCNTSAVTQACPKVT
FEPIPIHYCAPAGYAILKCNNETFNGTGPCSNVSTVQCTHGIRPVVSTQL

Figure 1 continued

```
LLNGSLAEKEIVIRSENLTNNAKIIIVHLHTPVEIVCTRPGNNTRKSVRI
GPGQTFYATGDIIGDIRQAHCNISEKQWNETLQKVGKELQKHFPNKTIKY
ERSAGGDMEITTHSFNCGGEFFYCNTSKLFNGTYNGTDISTNSSANSNST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKRAAG
LGALFLGFLGAAGSTMGAASITLTVQARQLLSGIVQQQSNLLRAIEAQQH
MLQLTVWGIKQLQARVLALERYLKDQQLLGMWGCSGKLICTTAVAWNTSW
SNKSEKDIWDNMTWMQWEREISNYTETIYKLLEDSQNQQERNEQDLLALD
SWNSLWNWFNITKWLWYIKIFIMIVGGLIGLRIVFAVLSIVNRVRQGYSP
LSLQTLTPNPREPDRLGGIEEEGGEQDRDRSIRLVSGFLPIVWDDLRSLC
LFSYHRLRDFLLLAARVVELLGRSSLRGLQRGWEVLKYLGSLVQYWGLEL
KKSAISLFDTLAIAVAEGTDRIIKVIQGFCRAIRNIPTRIRQGFEASLL*

>CH0848.3.d0700.15.29
MRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNENETSNTSE
YRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHT
PVEIVCTRPGNNTRKSVRIGPGQTFYATGDIIGDIRQAHCNISEEKWNET
LQKVGKELQKHFPNKTIKYAQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNNTSNEETFRPAGGDMRDNWRSELYKYKVVEIQP
LGIAPTGAKRRVVEREKRAAGLGALFLGFLGAAGSTMGAASITLTVQARQ
LLSGIVQQQSNLLRAIEAQQHMLQLTVWGIKQLQARVLALERYLKDQQLL
GMWGCSGKLICTTAVPWDSSWSNKSEKDIWDNMTWMQWEREISNYTETIY
KLLEDSQNQQERNEQDLLALDSWNSLWNWFNITNWLWYIKIFIMIVGGLI
GLRIVFAVLSIVNRVRQGYSPLSLQTLTPNPREPDRLGGIEEEGGEQDRD
RSIRLVSGFLPIVWDDLRSLCLFSYHRLRDFLLLAARVVELLGRSSLRGL
QRGWEVLKYLGSLVQYWGLELKKSAISLFDTIAIAVAEGTDRILEVIQGF
CRAIRNIPTRIRQGFEASLL*
>CH0848.3.d0700.15.34
TRVMGILKNYPQWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVNNRTMGEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGGIIGDIRQAHCNISEGQWNETLQKVGKELQKHFPNKTIKY
EQSAGGDMEITTHSFNCGGEFFYCNTSKLFNGTYNGTYISTNSSTNSTST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKRAAG
LGALFLGFLGAAGSTMGAASITLTVQARQLLSGIVQQQSNLLRAIEAQQH
MLQLTVWGIKQLQARVLALERYLKDQQLLGMWGCSGKLICTTNVPWNTSW
SNKSEKDIWDNMTWMQWEREISNYTETIYKLLEDSQNQQERNEQDLLALD
SWNSLWNWFNITKWLWYIKIFIMIVGGLIGLRIVFAVLSIVNRVRQGYSP
LSLQTLTPNPREPDRLGGIEEEGGEQDRDRSIRLVSGFLPIVWDDLRSLC
LFSYHRLRDFLLLAARVVELLGRSSLRGLQRGWEVLKYLGSLVQYWGLEL
KKSAISLFDTLAIAVAEGTDRIIELIQRSCRAIRNIPTRIRQGFEASLL*

>CH0848.3.d0700.15.06
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNNRV
```

Figure 1 continued

DQMHEDIISLWDQSLKPCVKLTPLCVTLICSNATVDNRTVGEMKNCSFNT
TTEIRDKEKKEYALFYKPDVVPLDETNNTSEYRLINCNTSAVTQACPKVT
FEPIPIHYCAPAGYAILKCNNETFNRTGPCSNVSTVQCTHGIRPVVSTQL
LLNGSLAEKEIVIRSENLTNNAKIIIVHLNTPVEIVCTRPNNNTRKSVRI
GPGQTFYATGGIIGDIRQAHCNISEGQWNETLQKVGKELQKHFPNKTIKY
EQSAGGDMEITTHSFNCGGEFFYCNTSKLFNGTYNGTYISTNSSTNSTST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKRAAG
LGALFLGFLGAAGSTMGAASITLTVQARQLLSGIVQQQSNLLRAIEAQQH
MLQLTVWGIKQLQARVLALERYLKDQQLLGMWGCSGKLICTTNVPWNTSW
SNKSEKDIWDNMTWMQWEREISNYTETIYKLLEDSQNQQERNEQDLLALD
SWNSLWNWFNITKWLWYIKIFIMIVGGLIGLRIVFAVLSIVNRVRQGYSP
LSLQTLTPNPREPDRLGGIEEEGGEQDRDRSIRLVSGFLPIVWDDLRSLC
LFSYHRLRDFLLLAARVVELLGRSSLRGLQRGWEVLKYLGSLVQYWGLEL
KKSAISLFDTLAIAVAEGTDRIIELIQRSCRAIRNIPTRIRQGFEASLL*

>CH0848.3.d0700.15.15
MRVTGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNETSNTSEYR
LINCNTSAVTQACPKVTFEPIPIHYCAPAGYAILKCNDETFNGTGPCSNV
STVQCTHGIRPVVSTQLLLNGSLAEKEIVIRSENLTNNAKIIIVHLHTPV
EIVCTRPGNNTRKSVRIGPGQTFYATGDIIGDIRQAHCNISEEKWNKTLQ
KVGKELQKHFPNKTIKYERPAGGDLEITTHSFNCGGEFFYCNTSKLFNGT
YNGTDISTNSSTNSTSTITLQCRIKQIINMWQGVGRAMYAPPIAGNITCK
SNITGLLLTRDGGTNSSEEIFRPAGGDMRDNWRSELYKYKVVEIQPLGIA
PTGAKRRVVEREKRAAGLGALFLGFLGAAGSTMGAASITLTVQARQLLSG
IVQQQSNLLRAIEAQQHMLQLTVWGIKQLQARVLALERYLKDQQLLGMWG
CSGKLICTTNVPWNTSWSNKSEKDIWDNMTWMQWEREISNYTETIYKLLE
DSQNQQERNEKDLLALDSWNSLWNWFNITKWLWYIKIFIIIVGGLIGLRI
VFAVLSIVNRVRQGYSPLSLQTLTPNPREPDRLGGIEEEGGEQDRDRSIR
LVSGFLPIVWDDLRSLCLFSYHRLRDFLLLAARVVELLGRSSLRGLQRGW
EVLKYLGSLVQYWGLELKKSAISLFDTIAIAVAEGTDRILEVIQRFCRAI
RNIPTRIRQGFEASLL*
>CH0848.3.d0780.25.05
TRVMGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVNNRTDYDTRSNVNVT
NITNTIKGEMKNCSFNTTTEIRDKEKKEYALFYRPDIVPLNENETSNTSE
YRLINCNTSAVTQACPKVTFEPIPIHYCAPAGYAILKCNDETFNGTGPCS
NVSTVQCTHGIRPVVSTQLLLNGSLAEKEIVIRSENLTNNAKIIIVHLNT
SVEIVCTRPGNNTRKSVRIGPGQTFYATGDIIGDIRQAHCNISESKWNET
LQKVGIELQKHFPNKTIKYEQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNSSEEIFRPAGGDMRDNWRSELYKYKVVEIQPLG
IAPTGAKRRVVEREKRAAGLGALFLGFLGAAGSTMGAASITLTVQARQLL
SGIVQQQSNLLRAIEAQQHMLQLTVWGIKQLQARVLALERYLKDQQLLGI
WGCSGKLICTTNVPWNTSWSNKSEKDIWDNMTWMQWEREISNYTETIYKL
LEDSQNQQERNEQDLLALDSWNSLWNWFNITKWLWYIKIFIMIVGGLIGL
RIVFAVLSIVNRVRQGYSPLSLQTLTPNPREPDRLRGIEEEGGEQDRDRS
IRLVSGFLPIVWDDLRSLCLFSYHRLRDFLLLAARVVELLGRSSLRGLQR
GWEVLKYLGSLVQYWGLELKKSAISLFDTLAIAVAEGTDRIIELIQGFCR
AIRNIPTRIRQGFEASLL*

Figure 1 continued

```
>CH0848.3.d0700.15.05
TRVMGILKNYPQWWIWGILGFWMLMICNGKGKLWVTVYYGVPVWKEAKTT
LFCASDAKAYKKEVHNVWATHACVPTDPSPQELVLGNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNENETSNTSE
YRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHT
PVEIVCTRPGNNTRKSVRIGPGQTFYATGDIIGDIRQAHCNISEEKWNET
LQKVGIELQKHFPNKTIKYEQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNNTSNEETFRPAGGDMRDNWRSELYKYKVVEIQP
LGIAPTGAKRRVVEREKRAAGLGALFLGFLGAAGSTMGAASITLTVQARQ
LLSGIVQQQSNLLRAIEAQQHMLQLTVWGIKQLQARVLALERYLKDQQLL
GMWGCSGKLICTTAVAWNTSWSNKSEKDIWDNMTWMQWEREISNYTETIY
KLLEDSQNQQERNEQDLLALDSWNSLWNWFNITKWLWYIKIFIMIVGGLI
GLRIVFAVLSIVNKVRQGYSPLSLQTLTPNPREPDRLRGIEEEGGEQDRD
RSIRLVSGFLPIVWDDLRSLCLFSYHRLRDFLLLAARVVELLGRSSLRGL
QRGWEVLKYLGSIVQYWGLELKKSAISLFDTLAIAVAEGTDRFIEVIQRF
CRAIRNIPTRIRQGFEASLL*
>CH0848.3.d0794.5.41
MRVMGILKNYPQWWIWGILGFWMLMICNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNRTVEEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLLNGSLAEKEIVIRSENLTNNAKIIIVHLNTPVEIVCTRPNNNTRKSVR
IGPGQTFYATGDIIGDIRQAHCNISEKEWNDTLQKVGKELQKHFPNKTIE
YKQSAGGDMEITTHSFNCGGEFFYCNTSNLFNGTYNGTYMNISTDSNSTI
TLQCRIKQIINMWQGVGRAMYAPPIAGNITCRSNITGLLLTRDGGTNSSK
TEEETFRPAGGDMRDNWRSELYKYKVVEIQPLGIAPTGAKRRVVEREKRA
AGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSEKDIWDNMTWMQWEREISNYTETIYKLLEDSQNQQERNEQDLLA
LDSWNSLWNWFNITKWLWYIKIFIMIVGGLIGLRIVFAVLSIVNRVRQGY
SPLSLQTLTPNPREPDRLRGIEEEGGEQDRDRSIRLVSGFLPIVWDDLRS
LCLFSYHRLRDFLLLAARVVELLGRSSLRGLQRGWEVLKYLGSLVQYWGL
ELKKSAISLLDTIAIAVAEGTDRIIGVIQRVCRAIRNIPTRIRQGFEASL
L*
>CH0848.3.d0794.3.03
TRVMGILKNYPQWWIWGILGFWMLMICNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVDNRTVGEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLLNGSLAEKGIVIRSENLTNNAKIIIVQLNTSVEIVCTRPNNNTRKSVR
IGPGQTFYATGDIIGEIRQAHCNISEEKWNETLQKVGKELQKHFPNKTIK
YAQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLGGIEEEGGEQDRDRSIRLVSGFLPIVWDDLR
```

Figure 1 continued

```
SLCLFSYHRLRDFLLLAARVVELLGRSSLRGLQRGWEVLKYLGSLVQYWG
LELKKSAISLFDTLAIAVAEGTDRIIELIQGFCRAIRNIPTRIRQGFEAS
LL*
>CH0848.3.d0836.10.36
MRVMGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVHLHTPVEIVCTRPNNNTRKSVR
IGPGQTFYATGDIIGDIRQAHCNISESKWNETLQKVGKELQKHFPNKTIK
YEQSAGGDMEITTHSFNCGGEFFYCTTSKLFNGTYNGTDISTNSSANSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLGGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIELIQGFCRAIRNIPTRIRQGFEAS
LL*
>CH0848.3.d0836.10.31
TRVMGILKNYPQWWIWGILGFWMLMICNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVHLHTPVEIVCTRPNNNTRKSVR
IGPGQTFYATGDIIGDIRQAHCNISESKWNETLQKVGKELQKHFPNKTIK
YAQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLGGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIELIQGFCRAIRNIPTRIRQGFEAS
LL*
>CH0848.3.d0808.15.27
TRVMGILKNYPQWWIWGILGFWMLMICNGKGKLWVTVYYGVPVWKEAKTT
LFCASDARAYEKEVHNVWATHACVPTDPSPQELFLDNVTENFNMWKNDMV
DQMHEDIISLWDQSLKPCVKLTPLCVTLICSNATVKNRTVYEMKNCSFNT
TTEIRDKEKKEYALFYRPDIVPLNENETSNTSEYRLINCNTSAVTQACPK
VTFEPIPIHYCAPAGYAILKCNNETFNGTGPCSNVSTVQCTHGIRPVVST
QLLLNGSLAEKEIVIRSENLTNNAKIIIVHLNTPVEIVCTRPNNNTRKSV
RIGPGQTFYATGDIIGDIRQAHCNISEKEWNETLQKVGKELQKHFPNKTI
KYEQSAGGDMEITTHSFNCGGEFFYCNTSNLFNGTYNGTDISTNSSAKSN
STITLQCRIKQIINMWQGVGRAMYAPPIAGNITCKSNITGLLLTRDGGNS
SKTEEETFRPAGGDMRDNWRSELYKYKVVEIQPLGIAPTGAKRRVVEREK
RAAGLGALFLGFLGAAGSTMGAASITLTVQARQLLSGIVQQQSNLLRAIE
AQQHMLQLTVWGIKQLQARVLALERYLKDQQLLGMWGCSGKLICTTNVPW
```

Figure 1 continued

```
NTSWSNKSEMDIWDNMTWMQWEREISNYTETIYMLLEDSQRQQERNEKDL
LALDSWNSLWNWFNITKWLWYIKIFIMIVGGLIGLRIVFAVLSIVNRVRQ
GYSPLSLQTLTPNPREPDRLRGIEEEGGEQDRDRSIRLVSGFLPIVWDDL
RSLCLFSYHRLRDFLLLAARVVELLGRSSLRGLQRGWEVLKYLGSLVQYW
GLELKKSAISLFDTLAIAVAEGTDRIIEAIQGFCRAIRNIPTRIRQGFEA
SLL*
>CH0848.3.d0864.7.39
MRVMGIPKNCPQWWIWGILGFWMLMICNGKGKLWVTIYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLNTPVEIVCTRPNNNTRKSVR
IGPGQTFYATGDIIGDIRQAHCNISEKEWNDTLQKVGKELQKHFPNKTIE
YKQSAGGDMEITTHSFNCGGEFFYCNTAKLFNGTYNGTDISTNSSADSNS
TITLQCRIKQIINMWQGVGRAMYAPPIAGNITCKSHITGLLLTRDGGTNS
SEEEEIFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLREIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIELIQGFCRAIRNIPTRIRQGFEASL
LL*
>CH0848.3.d0864.7.26
MRVTGILKNYPQWWIWGILGFWMLMNCNGKENLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNSTVDEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLNTPVEIVCTRPNNNTRKSV
RIGPGQTFYATGDIIGDIRQAHCNISEKEWNETLQKVGKELQKHFPNKTI
KYAQSAGGDMEITTHSFNCGGEFFYCNTANLFNGTYNGTDISTNSSTKSN
STITLQCRIKQIINMWQGVGRAMYAPPIAGNITCRSTITGLLLTRDGGNN
SSKTEEETFRPAGGDMRDNWRSELYKYKVVEIQPLGIAPTGAKRRVVERE
KRAAGLGALFLGFLGAAGSTMGAASITLTVQARQLLSGIVQQQSNLLRAI
EAQQHMLQLTVWGIKQLQARVLALERYLKDQQLLGMWGCSGKLICTTNVP
WNTSWSNKSKTDIWDNMTWMQWEREISNYTETIYKLLEDSQNQQERNEQD
LLALDSWNSLWNWFNITKWLWYIKIFIMIVGGLIGLRIVFAVLSIVNRVR
QGYSPLSLQTLTPNPREPDRLRGIEEEGGEQDRDRSIRLVSGFLPIVWDD
LRSLCLFSYHRLRDFLLLAARVVELLGRSSLRGLQRGWEVLKYLGSLVQY
WGLELKKSAISLFDTLAIAVAEGTDRIIEVIQGFCRAIRNIPRRIRQGFE
ASLL*
>CH0848.3.d0794.5.27
MRVMGIPKNYPQWWIWGILGFWMLMNCNGKENLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVDNRTVGEMKNCSFNT
TTEIRDKEKKEYALFYRPDIVPLSETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGEIKQAHCNISEEKWNETLQKVGKELQKHFPNKIIKY
AQSAGGDMEITTHSFNCGGEFFYCNTANLFNGTYNGTDISTNSSTKSNST
ITLQCRIKQIINMWQGVGRAMYAPPIAGNITCRSTITGLLLTRDGGTNSS
```

Figure 1 continued

KTEEETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSKTDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLGGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTIAIAVAEGTDRIIEAIQGFCRAIRNIPTRIRQGFEAS
LL*
>CH0848.3.d0949.10.18
TRVMGILKNYPQWWIWGILGFWMLMICNGKGKLWVTVYYGVPVWKEAKTT
LFCASDARAYEKEVHNVWATHACVPTDPSPQELFLDNVTENFNMWKNDMV
DQMHEDIISLWDQSLKPCVKLTPLCVTLICSTATVDNSTVEEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLHTPVEIVCTRPNNNTRKSV
RIGPGQTFYATGDIIGEIRQAHCNISEEEWNETLQKVGKELQKHFPNKTI
KYEQSAGGDMEITTHSFNCGGEFFYCNTANLFNGTYNGTDISTNSSTKSN
STITLQCRIKQIINMWQGVGRAMYAPPIAGNITCKSNVTGLLLTRDGGTN
SSQTEEETFRPAGGDMRDNWRSELYKYKVVEIQPLGIAPTGAKRRVVERE
KRAAGLGALFLGFLGAAGSTMGAASITLTVQARQLLSGIVQQQSNLLRAI
EAQQHMLQLTVWGIKQLQARVLALERYLKDQQLLGMWGCSGKLICTTNVP
WNTSWSNKSEMDIWDNMTWMQWEREISNYTETIYKLLEDSQNQQERNEQD
LLALDSWNSLWNWFNITKWLWYIKIFIMIVGGLIGLRIVFAVLSIVNRVR
QGYSPLSLQTLTPNPREPDRLRGIEEEGGEQDRDRSIRLVSGFLPIVWDD
LRSLCLFSYHRLRDFLLLAARVVELLGRSSLRGLQRGWEVLKYLGSLVQY
WGLELKKSAISLFDTLAIAVAEGTDRIIELIQRFCRAIRNIPTRIRQGFE
ASLL*
>CH0848.3.d0808.15.25
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNATVKNRTVEEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLNAPVEIVCTRPNNDTRKSV
RIGPGQTFYATGDIIGDIRQAHCNISEKEWNETLQKVGIELQKHFPNKTI
KYEQSAGGDMEITTHSFNCGGEFFYCNTSKLFNGTYNGTYINTSSNSTIT
LQCRIKQIINMWQGVGRAMYAPPIAGNITCKSDITGLLLTRDGGTNSSGK
EEIFRPAGGDMRDNWRSELYKYKVVEIQPLGIAPTGAKRRVVEREKRAAG
LGALFLGFLGAAGSTMGAASITLTVQARQLLSGIVQQQSNLLRAIEAQQH
MLQLTVWGIKQLQARVLALERYLKDQQLLGMWGCSGKLICTTNVPWNTSW
SNKSETDIWDNMTWMQWEREISNYTETIYKLLEDSQNQQERNEQDLLALD
SWNSLWNWFNITKWLWYIKIFIMIVGGLIGLRIVFAVLSIVNRVRQGYSP
LSLQTLTPNPREPDRLRGIEEEGGEQDRDRSIRLVSGFLPIVWDDLRSLC
LFSYHRLRDFLLLAARVVELLGRSSLRGLQRGWEVLKYLGSLVQYWGLEL
KKSAISLFDTLAIAVAEGTDRIIELIQGFCRAIRNIPTRIRQGFEASLL*

>CH0848.3.d0864.3.03
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNTVNNRTVYEMKNCSFNTT
TEIRDKEKKEYALFYRPDIVPLNENETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR

Figure 1 continued

```
IGPGQTFYATGDIIGEIRQAHCNISEKEWNETLQKVGKELQKHFPNKTIK
YAQSAGGDMEITTHSFNCGGEFFYCNTANLFNGTYNGTDISTNSSTKSNS
TITLQCRIKQIINMWQGVGRAMYAPPIAGNITCRSTITGLLLTRDGGNSS
KTEEETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSKTDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIELIQGFCRAIRNIPTRIRQGFEAS
LL*
>CH0848.3.d0893.10.05
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNTVNNRTVYEMKNCSFNTT
TEIRDKEKKEYALFYRPDIVPLNENETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR
IGPGQTFYATGDIIGEIRQAHCNISEEEWNDTLQKVGKELQKHFPNKTIE
YKQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGNSS
KTEEEIFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTGTIYKLLEDSQNQQERNEQELL
ALDSWNSLWNWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLTARVVELLGRSSLRGLQRGWEVLKYLGSLVQYWG
LELKKSAISLFDTIAIAVAEGTDRILEVIQRFCRAIRNIPTRIRQGFEAS
LL*
>CH0848.3.d0893.10.06
MRVTGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGDTRQAHCNISEKKWNETLQKVGIELQKHFPNKTIK
YNQSAGGDMEITTHSFNCGGEFFYCNTSNLFNGTYNGTYISTNSSANSTS
TITLQCRIKQIINMWQGVGRAMYAPPIAGNITCRSNITGLLLTRDGGTNS
NETETFRPAGGDMRDNWRSELYKYKVVEIQPLGIAPTGAKRRVVEREKRA
AGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSETDIWDNMTWMQWEREISNYTETIYKLLEDSQNQQERNEQDLLA
LDSWNSLWNWFSITKWLWYIKIFIMIVGGLIGLRIVFAVLSIVNRVRQGY
SPLSLQTLTPNPREPDRLRGIEEEGGEQDRDRSIRLVSGFLPIVWDDLRS
LCLFSYHRLRDFLLLAARVVELLGRSSLRGLQRGWEVLKYLGSLVQYWGL
ELKKSAISLFDTLAIAVAEGTDRIIELIQGFCRAIRNIPTRIRQGFEASL
L*
>CH0848.3.d0949.10.10
TRVMGILKNYPQWWIWGILGFWMLMNCNGEGNLWVTVYYGVPVWKEAKTT
LFCASDAKAYKKEVHNVWATHACVPTDPSPQELFLDNVTENFNMWKNDMV
DQMHEDIISLWDQSLKPCVKLTPLCVTLICSNATVENKTVEEMKNCSFNT
```

Figure 1 continued

TTEIRDKEKKEYALFYKPDVVPLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPNNNTRKSVRI
GPGQTFYATGDIIGDIKQAHCNISEKKWNETLQKVGIELQKHFPNKTIKY
NQSAGGDMEITTHSFNCGGEFFYCNTSNLFNGTYNGTYISTNSSANSTST
ITLQCRIKQIINMWQGVGRAMYAPPIAGNITCRSNITGLLLTRDGGTNSN
ETETFRPAGGDMRDNWRSELYKYKVVEIQPLGIAPTGAKRRVVEREKRAA
GLGALFLGFLGAAGSTMGAASITLTVQARQLLSGIVQQQSNLLRAIEAQQ
HMLQLTVWGIKQLQARVLALERYLKDQQLLGMWGCSGKLICTTNVPWNTS
WSNKSETDIWDNMTWMQWEREISNYTETIYKLLEDSQNQQERNEQDLLAL
DSWNSLWNWFSITKWLWYIKIFIMIVGGLIGLRIVFAVLSIVNRVRQGYS
PLSLQTLTPNPREPDRLRGIEEEGGEQDRDRSIRLVSGFLPIVWDDLRSL
CLFSYHRLRDFLLLAARVVELLGRSSLRGLQRGWEVLKYLGSLVQYWGLE
LKKSAISLFDTLAIAVAEGTDRIIEAIQGFCRAIRNIPTRIRQGFEASLL
*
>CH0848.3.d0949.10.17
TRVMGILKNYPQWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNGTVEEMKNCSFNT
TTEIRDKEKKEYALFYKPDIVPLSETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPNNNTRKSVRI
GPGQTFYATGDIIGDIKQAHCNISEEKWNDTLQKVGIELQKHFPNKTIKY
NQSAGGDMEITTHSFNCGGEFFYCNTSNLFNGTYNGTYISTNSSANSTST
ITLQCRIKQIINMWQGVGRAMYAPPIAGNITCRSNITGLLLTRDGGTNSN
ETETFRPAGGDMRDNWRSELYKYKVVEIQPLGIAPTGAKRRVVEREKRAA
GLGALFLGFLGAAGSTMGAASITLTVQARQLLSGIVQQQSNLLRAIEAQQ
HMLQLTVWGIKQLQARVLALERYLKDQQLLGMWGCSGKLICTTNVPWNTS
WSNKSETDIWDNMTWMQWEREISNYTETIYKLLEDSQNQQERNEQDLLAL
DSWNSLWNWFSITKWLWYIKIFIMIVGGLIGLRIVFAVLSIVNRVRQGYS
PLSLQTLTPNPREPDRLRGIEEEGGEQDRDRSIRLVSGFLPIVWDDLRSL
CLFSYHRLRDFLLLAARVVELLGRSSLRGLQRGWEVLKYLGSLVQYWGLE
LKKSAISLFDTLAIAVAEGTDRIIELIQGFCRAIRNIPTRIRQGFEASLL
*
>CH0848.3.d0808.15.15
TRVMGILKNYPQWWIWGILGFWMLMICNGKGKLWVTVYYGVPVWKEAKTT
LFCASDARAYEKEVHNVWATHACVPTDPSPQELFLKNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
GKEEIFRPAGGDMRDNWRSELYKYRVVEIQPLGIAPTGAKRRVVEREKRA
AGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSETDIWDNMTWMQWEREISNYTETIYKLLEDSQNQQERNEQDLLA
LDSWNSLWNWFNITKWLWYIKIFIMIVGGLIGLRIVFAVLSIVNRVRQGY
SPLSLQTLTPNPREPDRLGGIEEEGGEQDRDRSIRLVSGFLPIVWDDLRS
LCLFSYHRLRDFLLLAARVVELLGRSSLRGLQRGWEVLKYLGSLVQYWGL
ELKKSAISLFDTLAIAVAEGTDRIIELIQGFCRAIRNIPTRIRQGFEASL
L*
>CH0848.3.d0780.15.22

Figure 1 continued

```
TRVMGILKNYPQWWIWGILGFWMLMICNGKGKLWVTVYYGVPVWKEAKTT
LFCASDARAYEKEVHNVWATHACVPTDPNPQELVLGNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
EKEEIFRPAGGDMRDNWRSELYKYKVVEIQPLGIAPTGAKRRVVEREKRA
AGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSEKDIWDNMTWMQWEREISNYTETIYKLLEDSQNQQERNEKDLLA
LDSWNSLWNWFNITKWLWYIKIFIMIVGGLIGLRIVFAVLSIVNRVRQGY
SPLSLQTLTPNPREPDRLGGIEEEGGEQDRDRSIRLVSGFLPIVWDDLRS
LCLFSYHRLRDFLLLAARVVELLGRSSLRGLQRGWEVLKYLGSLVQYWGL
ELKKSAISLFDTLAIAVAEGTDRIIELIQRSCRAIRNIPTRIRQGFEASL
L*
>CH0848.3.d0780.15.29
TRVMGIPKNYPQWWIWGILGFWMLMICNGKGKLWVTVYYGVPVWKEAKTT
LFCASDAKAYKKEVHNVWATHACVPTDPNPQELVLGNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
EKEEIFRPAGGDMRDNWRSELYKYKVVEIQPLGIAPTGAKRRVVEREKRA
AGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSEKDIWDNMTWMQWEREISNYTETIYKLLEDSQNQQERNEKDLLA
LDSWNSLWNWFNITKWLWYIKIFIMIVGGLIGLRIVFAVLSIVNRVRQGY
SPLSLQTLTPNPREPDRLGGIEEEGGEQDRDRSIRLVSGFLPIVWDDLRS
LCLFSYHRLRDFLLLAARVVELLGRSSLRGLQRGWEVLKYLGSLVQYWGL
ELKKSAISLFNTIAIAVAEGTDRILEVIQGFCRAIRNIPTRIRQGFEASL
L*
>CH0848.3.d0808.15.43
TRVMGILKNYPQWWIWGILGFWMLMICNGKGKLWVTVYYGVPVWKEAKTT
LFCASDAKAYKKEVHNVWATHACVPTDPSPQELFLKNVTENLNMWKNDMV
DQMHEDIISLWDQSLKPCVKLTPLCVTLICSNATVKNRTVEEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLNGSLAEKEIVIRSENLTNNAKIIIVHLHTPVEIVCTRPNNNTRKSVR
IGPGQTFYATGDIIGDIRQAHCNISEKQWNDTLQKVGKELQKHFPNKTIK
YKHSAGGDMEITTHSFNCGGEFFYCNTSNLFNGTYNGTYMNISTDSNSTI
TLQCRIKQIINMWQGVGRAMYAPPIAGNITCKSHITGLLLTRDGGTNSSG
KEEIFRPAGGDMRDNWRSELYKYKVVEIQPLGIAPTGAKRRVVEREKRAA
GLGALFLGFLGAAGSTMGAASITLTVQARQLLSGIVQQQSNLLRAIEAQQ
HMLQLTVWGIKQLQARVLALERYLKDQQLLGMWGCSGKLICTTNVPWNTS
WSNKSETDIWDNMTWMQWEREISNYTETIYKLLEDSQNQQERNEQDLLAL
DSWNSLWNWFNITKWLWYIKIFIMIVGGLIGLRIVFAVLSIVNRVRQGYS
PLSLQTLTPNPREPDRLGGIEEEGGEQDRDRSIRLVSGFLPIVWDDLRSL
CLFSYHRLRDFLLLAARVVELLGRSSLRGLQRGWEVLKYLGSLVQYWGLE
```

Figure 1 continued

```
LKKSAISLFDTLAIAVAEGTDRIIELIQGFCRAIRNIPTRIRQGFEASLL
*
>CH0848.3.d1120.10.24
MRVMGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSTATVNKSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGGIVGDIRQAHCNISKGLWNDTLQKVGIELQKHFPNKTIK
YNQSAGGDMEITTHSFNCGGEFFYCNTSNLFNGTYNGTYISTNSSANSTS
YITLQCRIKQIINMWQGVGRAMYAPPIAGNITCRSNITGLLLTRDGGTTN
NSNETETFRPAGGDMRDNWRSELYKYKVVEIQPLGIAPTGAKRRVVEREK
RAAGLGALFLGFLGAAGSTMGAASITLTVQARQLLSGIVQQQSNLLRAIE
AQQHMLQLTVWGIKQLQARVLALERYLKDQQLLGMWGCSGKLICTTNVPW
NTSWSNKSETDIWDNMTWMQWEREISNYTETIYKLLEDSQNQQERNEQDL
LALDSWNSLWNWFSITKWLWYIKIFIMIVGGLIGLRIVFAVLSIVNRVRQ
GYSPLSLQTLTPNPREPDRLRGIEEEGGEQDRDRSIRLVSGFLPIVWDDL
RSLCLFSYHRLRDFLLLAARVVELLGRSSLRGLQRGWEVLKYLGSLVQYW
GLELKKSAISLFDTLAIAVAEGTDRIIELIQGFCRAIRNIPTRIRQGFEA
SLL*
>CH0848.3.d1120.10.05
TRVMGIPKNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSTATVNKSTVEEMKNCSFNT
TTEIRDKEKKEYALFYRPDIVPLNNKTSNTSEYRLINCNTSAVTQACPKV
TFEPIPIHYCAPAGYAILKCNDETFNGTGPCSNVSTVQCTHGIRPVVSTQ
LLLNGSLAEEEIVIRSENLTNNAKIIIVHLHTPVEIVCTRPNNNTRKSVR
IGPGQTFYATGGIIGDVRQAHCNISKGLWNDTLQKVGKELQKHFPNKTIR
YNQSAGGDMEITTHSFNCGGEFFYCNTAKLFNGTYNGTDISTNSSANNSS
TITLQCRIKQIINMWQGVGRAMYAPPIAGNITCKSNITGLLLTRDGGINS
SREEEIFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSEMDIWDNMTWMQWEREISNYTETIYKLLEDSQNQQERNEQDLL
ALDSWNSLWNWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAVAVAEGTDRIIEAIQGFCRAIRNIPTRIRQGFEAS
LL*
>CH0848.3.d1120.10.32
MRVTGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNAIVENGTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVQLNTSVEIVCTRPNNNTRKSVR
IGPGQTFYATGDIIGDPRQAHCNISKEKWNDTLQKVGKELQKHFPNKTIR
YNQSAGGDMEITTHSFNCGGEFFYCNTAKLFNSTYNGTYISTNSTNSTSN
ITLQCRIKQIINMWQGVGRAMYAPPIAGNITCRSNITGLLLTRDGGTTNN
SNETETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTGTIYKLLEDSQNQQERNEQDLL
```

Figure 1 continued

```
ALDSWNSLWNWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAVAVAEGTDRIIEVIQGFCRAIRNIPRRIRQGFEAS
LL*
>CH0848.3.d1432.5.27
MRVTGILKNYPRWWIWGILGFWMLMNCNGEGKLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLNCSNATVNNTTDYDSRSNANVT
NITNTIKEEVKNCSFKTTTEIRDKEKKEHALFYRPDIVPLNSETGNTSEY
RLINCNTSAVTQACPKVTFEPIPIHYCAPAGYAILKCNDETFNGTGPCSK
VSTVQCTHGIRPVVSTQLLLNGSLAEKGIVIRSENLTNNAKIIIVQLNTS
VEIVCTRPGNNTRKSMRIGPGQTFYATGDIIGDIRQAHCNISESKWNDTL
QKVGIELQKHFPNKTIKYNQSAGGDMEITTHSFNCGGEFFYCNTAKLFNS
TYNGTYISTNSSANSTSKNITLQCRIKQIINMWQGVGRAMYAPPIAGNIT
CRSNITGLLLTRDGGIHNDSNETETFRPAGGDMRDNWRSELYKYKVVEIQ
PLGIAPTGAKRRVVGREKRAAGLGALFLGFLGAAGSTMGAASITLTVQAR
QLLSGIVQQQSNLLRAIEAQQHMLQLTVWGIKQLQARVLALERYLKDQQL
LGIWGCSGKLICTTNVPWNTSWSNKSETDIWENMTWMQWEREISNYTETI
YKLLEDSQNQQERNEQDLLALDSWNSLWNWFSITKWLWYIKIFIMIVGGL
IGLRIVFAVLSIVNRVRQGYSPLSLQTLTPNPREPDRLRGIEEEGGEQDR
DKSIRLVNGFLPIVWDDLRSLCLFSYHRLRDFLLLAARVVELLGRSSLRG
LQRGWEVLKYLGSLVQYWGLELKKSAISLFDTLAIAVAEGTDRIIEAIQG
FCRAIRNIPTRIRQGFEASLL*
>CH0848.3.d1621.4.15
MRVTGILKNCPLWWIWGILGFWMLMNCNGEGNLWVTVYYGVPVWKEAKTT
LFCASDAKAYKKEVHNVWATHACVPTDPNPQEMFLKNVTENFNMWKNDMV
DQMHEDIISLWDQSLKPCVKLTPLCVTLNCSNATVNSTTDYDSRSNDSVT
NITNTIKEEVKNCSFKTTTEIRDKEKKEHALFYRPDIVPLNSETGNISEY
RLINCNTSAVTQACPKVTFEPIPIHYCAPAGYAILKCNDETFNGTGPCSN
VSTVQCTHGIRPVVSTQLLLNGSLAKEEIVIRSENLTNNAKIIIVQLNTS
VEIVCTRPGNNTRKSVRIGPGQTFYATGDIIGDIRQAHCNISEKKWNETL
QRVGIELQKHFPNKTIKYNQSAGGDMEITTHSFNCGGEFFYCNTAKLFNS
TYNGTYINTTSINSTLNITLQCRIKQIINMWQGVGRAMYAPPIAGNITCR
SNITGLLLTRDGGIHNDSNETETFRPAGGDMRDNWRSELYKYKVVEVQPL
GIAPTGAKRRVVEREKRAAGLGALFLGFLGAAGSTMGAASITLTVQARQL
LSGIVQQQSNLLRAIEAQQHMLQLTVWGIKQLQARVLALERYLKDQQLLG
IWGCSGKLICTTNVPWNTSWSNKSETDIWGNMTWMQWEREISNYTETIYK
LLEDSQNQQERNEQDLLALDSWNSLWSWFNITKWLWYIKIFIMIVGGLIG
LRIVFAVLSIVNRVRQGYSPLSLQTLTPNPREPDRLRGIEEEGGEQDRDK
SIRLVNGFLPIVWDDLRSLCLFSYHRLRDFLLLAARVVELLGRSSLRGLQ
RGWEVLKYLGSLVQYWGLELKKSAISLFDTLAVAVAEGTDRIIEAIQGFC
RAIRNIPRRIRQGFEASLL*
>CH0848.3.d1621.4.12
MRVTGILKNYPRWWIWGILGFWMLMNCNGEGKLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLNCSNATVNSTTDYDSRSNDTVT
NITNTIKEEVKNCSFKTTTEIRDKEKKEHALFYRPDIVPLNSETGNTSEY
RLINCNTSAVTQACPKVTFEPIPIHYCAPAGYAILKCNDETFNGTGPCSN
VSTVQCTHGIRPVVSTQLLLNGSLAKEEIVIRSENLTNNAKTIIVHLHTP
VEIVCTRPGNNTRKSMRIGPGQTFYATGDIIGDIRQAHCNISEEKWNKTL
QEVGKELQKHFPNRTIKYNQSAGGDMEITTHSFNCGGEFFYCNTSKLFNS
TYNDTYISTNSTNSSANNSSIITLQCRIKQIINMWQGVGRAMYAPPIAGN
IICKSNITGLLLTRDGGPDSNKTETFRPAGGDMRDNWRSELYKYKVVEVQ
```

Figure 1 continued

PLGIAPTGAKRRVVEREKRAAGLGALFLGFLGAAGSTMGAASITLTVQAR
QLLSGIVQQQSNLLRAIEAQQHMLQLTVWGIKQLQARVLALERYLKDQQL
LGIWGCSGKLICTTNVPWNTSWSNKSETDIWGNMTWMQWEREISNYTETI
YKLLEDSQNQQERNEQDLLALDSWNSLWSWFNITKWLWYIKIFIMIVGGL
IGLRIVFAVLSIVNRVRQGYSPLSLQTLTPNPREPDRLRGIEEEGGEQDR
DKSIRLVNGFLPIVWDDLRSLCLFSYHRLRDFLLLAARVVELLGRSSLRG
LQRGWEVLKYLGSLVQYWGLELKKSAISLFDTLAIAVAEGTDRIIEAIQG
FCRAIRNIPRRIRQGFEASLL*
>CH0848.3.d1120.10.13
MRVTGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSHATVENSTTEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGGIIGEIRQAHCNISKETWNDTLQKVGKELQKHFPNKTIR
YNQSAGGDMEITTHSFNCGGEFFYCNTAKLFNSTYNGTYISTNSTNSTSY
ITLQCRIKQIINMWQGVGRAMYAPPIAGNITCRSNITGLLLTRDGGTNSS
EEEIFRPAGGDMRDNWRSELYKYKVVEVQPLGIAPTGAKRRVVEREKRAA
GLGALFLGFLGAAGSTMGAASITLTVQARQLLSGIVQQQSNLLRAIEAQQ
HMLQLTVWGIKQLQARVLALERYLKDQQLLGMWGCSGKLICTTNVPWNTS
WSNKSETDIWDNMTWMQWEREISNYTETIYKLLEDSQNQQERNEQDLLAL
DSWNSLWNWFSITKWLWYIKIFIMIVGGLIGLRIVFAVLSIVNRVRQGYS
PLSLQTLTPNPREPDRLRGIEEEGGEQDRDRSIRLVSGFLPIVWDDLRSL
CLFSYHRLRDFLLLAARVVELLGRSSLRGLQRGWEVLKYLGSLVQYWGLE
LKKSAISLFDTLAIAVAEGTDRIIELIQGFCRAIRNIPTRIRQGFEASLL
*
>CH0848.3.d1120.10.21
MRVTGILKNYPQWWIWGILGFWMLMICNGEENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLMCSNAIVKNSTTEEMKNCSFNT
TTEIRDKEKKEYALFYRPDIVPLNNKTSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVQIVCTRPNNNTRKSVR
IGPGQTFYATGDIIGDPRQAHCNISEKKWNETLQKVGIELQKHFPNKTIK
YNQSAGGDMEITTHSFNCGGEFFYCNTAKLFNSTYNGTYISTNSTDSTSN
ITLQCRIKQIINMWQGVGRAMYAPPIAGNITCRSNITGLLLTRDGGINND
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTETIYKLLEDSQNQQERNEQDLL
ALDSWNSLWNWFSITKWLWYIKIFIMIVGGLIGLRIVFAVLSIVNRVRQG
YSPLSLQTLTPNPREPDRLRGIEEEGGEQDKDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIEAIQGFCRAIRNIPTRIRQGFEAS
LL*
>CH0848.3.d1120.10.41
MRVMGIQKNYPRWWIWGILGFWMLMICNGEGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNSTTEEMKNCSFNT
TTEIRDKEKKEHALFYRPDIVPLNNETGNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR
IGPGQTFYATGDIIGDIKQAHCNISEEKWNDTLQKVGIELQKHFPNKTIK

Figure 1 continued

```
YNQSAGGDMEITTHSFNCGGEFFYCNTSKLFNSTYNGTYISTNSTNSTSY
ITLQCRIKQIINMWQGVGRAMYAPPIAGNITCRSNITGLLLTRDGGINND
SNETETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSEMDIWDNMTWMQWEREISNYTGTIYKLLEDSQNQQERNEQDLL
ALDSWNSLWNWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAVAVAEGTDRIIEVIQGFCRAIRNIPRRIRQGFEAS
LL*
>CH0848.3.d1305.10.21
MRVTGILKNYPRWWIWGILGFWMLMICNGKGKLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLICSNATVENSTTEEMKNCSFNT
TTEIRDKEKKEHALFYRPDIVPLNNETGNTSEYRLINCNTSAVTQACPKV
TFEPIPIHYCAPAGYAILKCNDETFNGTGPCSKVSTVQCTHGIRPVVSTQ
LLLNGSLAEKGIVIRSENLTNNAKIIIVQLNTSVEIVCTRPNNNTRKSVR
IGPGQTFYATGDIIGNIRQAHCNISESKWNDTLQKVGIELQKHFPNKTIK
YNQSAGGDMEITTHSFNCGGEFFYCNTAKLFNSTYNGTYISTNSTNSTSK
NITLQCRIKQIINMWQGVGRAMYAPPIAGNITCRSNITGLLLTRDGGTTN
NSNETETFRPAGGDMRDNWRSELYKYKVVEVQPLGIAPTGAKRRVVEREK
RAAGLGALFLGFLGAAGSTMGAASITLTVQARQLLSGIVQQQSNLLRAIE
AQQHMLQLTVWGIKQLQARVLALERYLKDQQLLGIWGCSGKLICTTNVPW
NTSWSNKSETDIWGNMTWMQWEREISNYTETIYKLLEDSQNQQERNEQDL
LALDSWNSLWSWFNITKWLWYIKIFIMIVGGLIGLRIVFAVLSIVNRVRQ
GYSPLSLQTLTPNPREPDRLRGIEEEGGEQDRDKSIRLVNGFLPIVWDDL
RSLCLFSYHRLRDFLLLAARVVELLGRSCLRGLQRGWEVLKYLGSLVQYW
GLELKKSAISLFDTLAITVAEGTDRIIELIQGFCRAIRNIPRRIRQGFEA
SLL*
>CH0848.3.d1432.5.06
TRVMGIPKNYPRWWIWGILGFWMLMICNGKGKLWVTVYYGVPVWKEAKTT
LFCASDAKAYVKEVHNVWATHACVPTDPSPQELLLKNVTENFNMWKNDMV
DQMHEDIISLWDQSLKPCVKLTPLCVTLICSNATVENSTTDEMKNCSFNT
TTEIRDKEKKERALFYRPDIVPLNNETGNTSEYRLINCNTSAITQACPKV
TFEPIPIHYCAPAGYAILKCNDETFNGTGPCSSVSTVQCTHGIRPVVSTQ
LLLNGSLAEKGIVIRSENLTNNAKIIIVHLNASVEIVCTRPNNNTRKSVR
IGPGQTFYATGDIIGDIRQAHCNISEKKWNETLQKVGIELQKHFPNKTIK
YNQSAGGDMEITTHSFNCGGEFFYCNTAKLFNSTYNGTYISTNSINSTLN
ITLQCRIKQIINMWQGVGRAMYAPPIAGNITCRSNITGLLLTRDGGIHND
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGIWGCSGKLICTTNVPWN
TSWSNKSETDIWGNMTWMQWEREISNYTETIYKLLEDSQNQQERNEQDLL
ALDSWNSLWSWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAVAVAEGTDRIIEAIQGFCRAIRNIPTRIRQGFEAS
LL*
>CH0848.3.d1432.5.48
TRVMGIPKNYPRWWIWGILGFWMLMICNGKGKLWVTVYYGVPVWKEAKTT
LFCASDAKAYVKEVHNVWATHACVPTDPSPQELLLKNVTENFNMWKNDMV
DQMHEDIISLWDQSLKPCVKLTPLCVTLICSNATVENSTTDEMKNCSFNT
TTEIRDKEKKERALFYRPDIVPLNNETGNTSEYRLINCNTSAITQACPKV
```

Figure 1 continued

```
TFEPIPIHYCAPAGYAILKCNDETFNGTGPCSSVSTVQCTHGIRPVVSTQ
LLLNGSLAEKGIVIRSENLTNNAKIIIVHLNASVEIVCTRPNNNTRKSVR
IGPGQTFYATGDIIGDIRQAHCNISEKKWNETLQKVGIELQKHFPNKTIK
YNQSAGGDMEITTHSFNCGGEFFYCNTAKLFNSTYNGTYISTNSINSTLN
ITLQCRIKQIINMWQGVGRAMYAPPIAGNITCRSNITGLLLTRDGGIHND
SNETETFRPAGGDMRDNWRSELYKYKVVEIQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGIWGCSGKLICTTNVPWN
TSWSNKSETDIWENMTWMQWEREISNYTETIYKLLEDSQNQQERNEQDLL
ALDSWNSLWSWFNITKWLWYIKIFIMIVGGLIGLRIVFAVLSIVNRVRQG
YSPLSLQTLTPNPREPDRLRGIEEEGGEQDRDKSIRLVNGFLPIVWDDLR
SLCLFSYHRLRDFLLLAARVVELLGRSSLRGLQRGWEVLKYLGSLVQYWG
LELKKSAISLFDTLAVAVAEGTDRIIEAIQGFCRAIRNIPRRIRQGFEAS
LL*
>CH0848.3.d1432.5.35
TRVMGIPKNYPRWWIWGILGFWMLMICNGKGKLWVTVYYGVPVWKEAKTT
LFCASDAKAYVKEVHNIWATHACVPTDPSPQELLLKNVTENFNMWKNDMV
DQMHEDIISLWDQSLKPCVKLTPLCVTLICSNATVNQSTTEEMKNCSFNT
TTEIRDKEKKEHALFYRPDIVPLDNETGNTSEYRLINCNTSAVTQACPKV
TFEPIPIHYCAPAGYAILKCNDETFNGTGPCSKVSTVQCTHGIRPVVSTQ
LLLNGSLAEKGIVVRSENLTNNAKIIIVQLNASVEIVCTRPNNNTRKSVR
IGPGQTFYATGDIIGNIRQAHCNISEKKWNETLQKVGIELQKHFPNKTIK
YNQSAGGDMEITTHSFNCGGEFFYCNTAKLFNSTYNGTYISTNSINSTLN
ITLQCRIKQIINMWQGVGRAMYAPPIAGNITCRSNITGLLLTRDGGIHND
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGIWGCSGKLICTTNVPWN
TSWSNKSETDIWENMTWMQWEREISNYTETIYKLLEDSQNQQERNEQDLL
ALDSWNSLWSWFNITKWLWYIKIFIMIVGGLIGLRIVFAVLSIVNRVRQG
YSPLSLQTLTPNPREPDRLRGIEEEGGEQDRDRSIRLVSGFLPIVWDDLR
SLCLFSYHRLRDFLLLAARVVELLGRSSLRGLQRGWEVLKYLGSLVQYWG
LELKKSAISLFDTLAIAVAEGTDRIIEAIQGFCRAIRNIPTRIRQGFEAS
LL*
>CH0848.3.d1720.5.01
MRVTGILKNCPLWWIWGILGFWMLMNCNGEGNLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVRNSTTEKMSDALDRN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAKEEIVIRSENLTNNAKIIIVQLNANASVE
IVCTRPNNNTRKSVRIGPGQTFYATGDIIGDIRQAHCNISEKKWNETLQQ
VGIELQKHFPNKTIKYNQSAGGDMEITTHSFNCGGEFFYCNTAKLFNSTY
NGTYISTDSINSTLNITLQCRIKQIINMWQGVGRAMYAPPIAGNITCRSN
ITGLLLTRDGGIHNDSNVTETFRPAGGDMRDNWRSELYKYKVVEIQPLGI
APTGAKRRVVGREKRAAGLGALFLGFLGAAGSTMGAASITLTVQARQLLS
GIVQQQSNLLRAIEAQQHMLQLTVWGIKQLQARVLALERYLKDQQLLGIW
GCSGKLICTTNVPWNTSWSNKSETDIWDNMTWMQWEREISNYTGTIYKLL
EESQNQQERNEQDLLALDSWNSLWSWFNITKWLWYIKIFIMIVGGLIGLR
IVFAVLSIVNRVRQGYSPLSLQTLTPNPREPDRLRGIEEEGGEQDRDKSI
RLVSGFLPIVWDDLRSLCLFSYHRLRDFLLLAARVVELLGRSSLRGLQRG
WEVLKYLGSLVQYWGLELKKSAISLFDTLAIAVAEGTDRIIEAIQGFCRA
IRNIPRRIRQGFEASLL*
>CH0848.3.d1651.7.50
MRVMGILKNYPRWWIWGILGFWMLMICNGKGKLWVTVYYGVPVWKEAKTT
```

Figure 1 continued

```
LFCASDAKAYVKEVHNVWATHACVPTDPSPQELVLDNVTENFNMWKNDMV
DQMHEDIISLWDQSLKPCVKLTPLCVTLNCSNAIVKNSTTEELSNALARN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAEKGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTTKLFNSTY
NGTYISTNSINSTLNITLQCRIKQIINMWQGIGRAMYAPPIAGNITCRSN
ITGLLLTRDGGIHNDSNETETFRPAGGDMRDNWRSELYKYKVVEIQPLGI
APTGAKRRVVERGKRAAGLGALFLGFLGAAGSTMGAASITLTVQARQLLS
GIVQQQSNLLRAIEAQQHMLQLTVWGIKQLQARVLALERYLKDQQLLGIW
GCSGKLICTTNVPWNTSWSNKSEMDIWDNMTWMQWEREISNYTGTIYKLL
EDSQNQQERNEQDLLALDSWNSLWNWFDITKWLWYIKIFIMIVGGLIGLR
IVFAVLSIVNRVRQGYSPLSLQTLTPNPREPDRLRGIEEEGGEQDRDKSI
RLVNGFLPIVWDDLRSLCLFSYHRLRDFLLLAARVVELLGRSCLRGLQRG
WEVLKYLGSLVQYWGLELKKSAISLFDTLAVAVAEGTDRIIEVIQGFCRA
IRNIPRRIRQGFEASLL*
>CH0848.3.d1651.10.07
TRVMGIPKNYPLWWIWGILGFWMLMNCNGEGNLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVKNSTTEEISHALARN
STTEEMKNCSFNTTTEIRDKEKKEYALFYRPDIVPLNNKTSNISEYRLIN
CNTSTVTQACPKVTFEPIPIHYCAPAGYAILKCNDETFNGTGPCSNVSTV
QCTHGIRPVVSTQLLLNGSLAEKGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSN
ITGLLLTRDGGIHNDSNVTETFRPAGGDMRDNWRSELYKYKVVEIQPLGI
APTGAKRRVVERGKRAAGLGALFLGFLGAAGSTMGAASITLTVQARQLLS
GIVQQQSNLLRAIEAQQHMLQLTVWGIKQLQARVLALERYLKDQQLLGIW
GCSGKLICTTNVPWNTSWSNKSEMDIWNNMTWMQWEREISNYTGTIYKLL
EDSQNQQERNEQDLLALDSWNSLWNWFDITKWLWYIKIFIMIVGGLIGLR
IVFAVLSIVNRVRQGYSPLSLQTLTPNPREPDRLRGIEEEGGEQDRDKSI
RLVNGFLPIVWDDLRSLCLFSYHRLRDFLLLAARVVELLGRSSLRGLQRG
WEVLKYLGSLVQYWGLELKKSAISLFDTLAVAVAEGTDRIIELIQGFCRA
IRNIPRRIRQGFEASLL*
>CH0848.3.d1621.4.46
MRVMGILKNYPRWWIWGILGFWMLMICNGKGKLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVKNSTTEELSNALARN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAKEGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSN
ITGLLLTRDGGIHNDSNETETFRPAGGDMRDNWRSELYKYKVVEIQPLGI
APTGAKRRVVEREKRAAGLGALFLGFLGAAGSTMGAASITLTVQARQLLS
GIVQQQSNLLRAIEAQQHMLQLTVWGIKQLQARVLALERYLKDQQLLGIW
GCSGKLICTTNVPWNTSWSNKSETDIWDNMTWMQWEREISNYTGTIYKLL
EESQNQQERNEQDLLALDSWNSLWNWFNITKWLWYIKIFIMIVGGLIGLR
IVFAVLSIVNRVRQGYSPLSLQTLTPNPREPDRLRGIEEEGGEQDRDKSI
RLVNGFLPIVWDDLRSLCLFSYHRLRDFLLLAARVVELLGRSSLRGLQRG
WEVLKYLGSLVQYWGLELKKSAISLFDTLAVAVAEGTDRIIEAIQGFCRA
```

Figure 1 continued

```
IRNIPRRIRQGFEASLL*
>CH0848.3.d1305.10.35
MRVTGIRKNCPQWWIWGILGFWMLMNCNGEGNLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLICSTATVNNSKFEEMKNCSFNT
TTEIRDKEKKEYALFYRPDIVPLDNETSNISEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGNPRQAHCNISKERWNDTLQKVGKELQKHFPNKTIK
YNQSAGGDMEITTHSFNCGGEFFYCNTSNLFNSTYNDTYISTNSTNSTSY
ITLQCRIKQIINMWQGVGRAMYAPPIAGNITCKSNITGLLLTRDGGINKD
SNETETFRPAGGDMRDNWRSELYKYKVVEVQPLGIAPTGAKRRVVEREKR
AAGLGALFLGFLGAAGSTMGAASITLTVQARQLLSGIVQQQSNLLRAIEA
QQHMLQLTVWGIKQLQARVLALERYLKDQQLLGMWGCSGKLICTTNVPWN
TSWSNKSETDIWDNMTWMQWEREISNYTGTIYKLLEDSQNQQERNEQDLL
ALDSWNSLWNWFSITKWLWYIKIFIMIVGGLIGLRIVFAVLSIVNRVRQG
YSPLSLQTLTPNPREPDRLRGIEEEGGEQDRDKSIRLVNGFLPIVWDDLR
SLCLFSYHRLRDFLLLAARVVELLGRSSLRGLQRGWEVLKYLGSLVQYWG
LELKKSAISLFDTLAVAVAEGTDRIIEVIQGFCRAIRNIPRRIRQGFEAS
LL*
>CH0848.3.d1305.10.13
MRVTGILKNYPRWWIWGILGFWMLMICNGKGKLWVTVYYGVPVWKEAKTT
LFCASDARAYEKEVHNVWATHACVPTDPSPQELVLDNVTENFNMWKNDMV
DQMHEDIISLWDQSLKPCVKLTPLCVTLICSIATANGSTVEEMKNCSFNT
TTEIRDKEKKEYALFYRPDIVPLNNKTSNISEYRLINCNTSAVTQACPKV
TFEPIPIHYCAPAGYAILKCNNETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGNPRQAHCNISKERWNDTLQKVGKELQKHFPNKTIR
YNQSAGGDMEITTHSFNCGGEFFYCNTSNLFNSTYNDTYISTNSSANNSS
TITLQCRIKQIINMWQGVGRAMYAPPIAGNITCKSNITGLLLTRDGGTDS
NETETFRPAGGDMRDNWRSELYKYKVVEIQPLGIAPTGAKRRVVEREKRA
VGLGALFLGFLGAAGSTMGAASITLTVQARQLLSGIVQQQSNLLRAIEAQ
QHMLQLTVWGIKQLQARVLALERYLKDQQLLGMWGCSGKLICTTNVPWNT
SWSNKSETDIWDNMTWMQWEREISNYTGTIYKLLEDSQNQQERNEQDLLA
LDSWNNLWSWFSITKWLWYIKIFIMIVGGLIGLRIVFAVLSIVNRVRQGY
SPLSLQTLTPNPRELDRLRGIEEEGGEQDRDKSIRLVDGFLPIVWDDLRS
LCLFSYHRLRDFLLLAARVVELLGRSSLRGLQRGWEVLKYLGSLVQYWGL
ELKKSAISLFDTLAVAVAEGTDRIIEVIQGFCRAIRNIPRRIRQGFEASL
L*
>CH0848.3.d1432.5.56
MRVTGILKNYPRWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMKNCSFNTTTEIRDKEKKEYALFYRPDVVPLDETNNTSKYRLINC
NTSAVTQACPKVTFEPIPIHYCAPAGYAILKCNDETFNGTGPCSNVSTVQ
CTHGIRPVVSTQLLLNGSLAEKEIVIRSENLTNNAKIIIVHLHTPVEIVC
TRPYNNTRKSVRIGPGQTFYATGDIIGDPRQAHCNISKEIWNKTLQEVGK
ELQKHFPNKTIRYNQSAGGDMEITTHSFNCGGEFFYCNTAKLFNSTYNDT
YKSTNSSANNSSIITLQCRIKQIINMWQGVGRAMYAPPIAGNITCKSNIT
GLLLTRDGGINNVSNETETFRPAGGDNWRSELYKYKVVEVQPLGIAPTGA
KRRVVEREKRAVGLGALFLGFLGAAGSTMGAASITLTVQARQLLSGIVQQ
QSNLLRAIEAQQHMLQLTVWGIKQLQARVLALERYLKDQQLLGMWGCSGK
LICTTNVPWNTSWSNKSETDIWDNMTWMQWEREISNYTGTIYKLLEDSQN
QQERNEQDLLALDSWNSLWNWFSITKWLWYIKIFIMIVGGLIGLRIVFAV
```

Figure 1 continued

```
LSIVNRVRQGYSPLSLQTLTPNPREPDRLRGIEEEGGEQDRDKSIRLVNG
FLPIVWDDLRSLCLFSYHRLRDFLLLAARVVELLGRSCLRGLQRGWEVLK
YLGSLVQYWGLELKKSAISLFDTLAVAVAEGTDRIIELIQGFCRAIRNIP
RRIRQGFEASLL*
>CH0848.3.d1432.5.18
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMSNATVKNSTTEEMKNCSFNTTTEIRDKEKKEYALFYRPDVVPLD
ETNNTSKYRLINCNTSAVTQACPKVTFEPIPIHYCAPAGYAILKCNDETF
NGTGPCSKVSTVQCTHGIRPVVSTQLLLNGSLAEKEIVIRSENLTNNAKI
IIVHLHTPVEIVCTRPYNNTRKSVRIGPGQTFYATGDIIGDPRQAHCNIS
KEIWNKTLQEVGKELQKHFPNKTIRYNQSAGGDMEITTHSFNCGGEFFYC
NTSNLFNSTYNDTYISPNSTNSTSTITLQCRIKQIINMWQGVGRAMYAPP
IAGNITCKSNITGLLLTRDGGINNVSNETETFRPAGGDMRDNWRSELYKY
KVVEVQPLGLAPTGAKRRVVEREKRAAGLGALFLGFLGAAGSTMGAASIT
LTVQARQLLSGIVQQQSNLLRAIEAQQHMLQLTVWGIKQLQARVLALERY
LKDQQLLGMWGCSGKLICTTNVPWNTSWSNKSETDIWDNMTWMQWEREIS
NYTGTIYKLLEDSQNQQERNEQDLLALDSWNSLWNWFSITKWLWYIKIFI
MIVGGLIGLRIVFAVLSIVNRVRQGYSPLSLQTLTPNPREPDRLRGIEEE
GGEQDRDKSIRLVNGFLPIVWDDLRSLCLFSYHRLRDFLLLAARVVELLG
RSSLRGLQRGWEVLKYLGSLVQYWGLELKKSAISLFDTLAVAVAEGTDRI
IEVIQGFCRAIRNIPRRIRQGFEASLL*
>CH0848.3.d1432.5.26
TRVMGILKNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMKNCSFNTTTEIRDKEKKEYALFYRPDVVPLDETNNTSKYRLINC
NTSAVTQACPKVTFEPIPIHYCAPAGYAILKCNDETFNGTGPCSNVSTVQ
CTHGIRPVVSTQLLLNGSLAEKEIVIRSENLTNNAKTIIVHLHTPVEIVC
TRPYNNTRKSVRIGPGQTFYATGDIIGDPRQAHCNISKETWNKTLQEVGK
ELQKHFPNKTIRYNQSAGGDMEITTHSFNCGGEFFYCNTSNLFNSTYNDT
YISPNSTNSTSTITLQCRIKQIINMWQGVGRAMYAPPIAGNITCKSNITG
LLLTRDGGTTNNSNETETFRPAGGDMRDNWRSELYKYKVVEVQPLGLAPT
GAKRRVVEREKRAAGLGALFLGFLGAAGSTMGAASITLTVQARQLLSGIV
QQQSNLLRAIEAQQHMLQLTVWGIKQLQARVLALERYLKDQQLLGIWGCS
GKLICTTNVPWNTSWSNKSEMDIWGNMTWMQWEREISNYTGTIYKLLEDS
QNQQERNEQDLLALDSWNNLWNWFSITKWLWYIKIFIMIVGGLIGLRIVF
AVLSIVNRVRQGYSPLSLQTLTPNPREPDRLRRIEEEGGEQDRDRSIRLV
NGFLPIVWDDLRSLCLFSYHRLRDFLLLAARVVELLGRSSLRGLQRGWEV
LKYLGSLVQYWGLELKKSAISLFDTLAIAVAEGTDRIIELIQGFCRVIRN
IPRRIRQGFEASLL*
>CH0848.3.d1432.5.41
MRVTGILRNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSTALVKN
STTEAMKNCSFNTTTEIRDKEKKEYALFYRPDIVPLNNETGNISEYRLIN
CNTSAVTQACPKVTFEPIPIHYCAPAGYAILKCNDETFNGTGPCSNVSTV
QCTHGIRPVVSTQLLLNGSLAKEEIVIRSENLTNNAKIIIVHLHTPVEIV
CTRPNNNTRKSVRIGPGQTFYATGDIIGDPRKAHCNISEKDWNKTLQEVG
KELQKHFPNKTIRYNQSAGGDMEITTHSFNCGGEFFYCNTSKLFNSTYND
TYISTNSSANNSSTITLQCRIKQIINMWQGVGRAMYAPPIAGNITCKSNI
TGLLLTRDGGPDSNETETFRPAGGDMRDNWRSELYKYKVVEVQPLGIAPT
GAKRRVVEREKRAAGLGALFLGFLGAAGSTMGAASITLTVQARQLLSGIV
```

Figure 1 continued

```
QQQSNLLRAIEAQQHMLQLTVWGIKQLQARVLALERYLKDQQLLGIWGCS
GKLICTTNVPWNTSWSNKSETDIWGNMTWMQWEREISNYTETIYKLLEDS
QNQQERNEQNLLALDSWNSLWNWFSITKWLWYIKIFIMIVGGLIGLRIVF
AVLSIVNRVRQGYSPLSLQTLTPNPREPDRLRGIEEEGGEQDRDKSIRLV
NGFLPIVWDDLRSLCLFSYHRLRDFLLLAARVVELLGRSSLRGLQRGWEV
LKYLGSLVQYWGLELKKSAISLLDTIAIAVAEGTDRIIEAIQGFCRAIRN
IPRRIRQGFEASLL*
>CH0848.3.d1651.10.04
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVENSTEAMK
NCSFNTTTEIRDKIKKERALFYRPDIVPLNNETGNISEYRLINCNTSAVT
QACPKVTFEPIPIHYCAPAGYAILKCNDETFNGTGPCSNVSTVQCTHGIR
PVVSTQLLLNGSLAEKEIVIRSENLTNNAKIIIVHLHNPVEIVCTRPYNN
TRKSVRIGPGQTFYATGDIIGDPRKAHCNISKEEWNKTLQEVGKELQKHF
PNKTIRYNQSAGGDMEITTHSFNCGGEFFYCNTSNLFNSTYNDTYISPNS
TNSTSIITLQCRIKQIINMWQGVGRAMYAPPIAGNITCKSNITGLLLTRD
GGPESNETETFRPAGGDMRDNWRSELYKYKVVEVQPLGIAPTGAKRRVVE
REKRAAGLGALFLGFLGAAGSTMGAASITLTVQARQLLSGIVQQQSNLLR
AIEAQQHMLQLTVWGIKQLQARVLALERYLKDQQLLGIWGCSGKLICTTN
VPWNTSWSNKSETDIWGNMTWMQWEREISNYTETIYKLLEDSQNQQERNE
QDLLALDSWNSLWSWFNITKWLWYIKIFIMIVGGLIGLRIVFAVLSIVNR
VRQGYSPLSLQTLTPNPREPDRLRGIEEEGGEQDRDRSIRLVSGFLPIVW
DDLRSLCLFSYHRLRDFLLLAARVVELLGHSSLRGLQRGWEVLKYLGSLV
QYWGLELKRSTISLFDTLAIAVAEGTDRIIELIQGFCRAIRNIPTRIRQG
FEASLL*
>CH0848.3.d1651.7.34
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEKMSNVTVNN
ITIEEMKNCSFNTTTEIRDKIKKERALFYRPDIVPLNDETNNTSKYRLIN
CNTSAVTQACPKVTFEPIPIHYCAPAGYAILKCNDETFNGTGPCSNVSTV
QCTHGIRPVVSTQLLLNGSLAEKEIVIRSENLTNNVKTIIVHLHAPVEIV
CTRPYNNTRKSVRIGPGQTFYATGDIIGDPRKAHCNISEKDWNKTLQEVG
KELQKHFPNKTIRYNQSAGGDMEITTHSFNCGGEFFYCNTSKLFNSTYND
TYISTNSTNSSANNSSIITLQCRIKQIINMWQGVGRAMYAPPIAGNITCK
SNITGLLLTRDGGPDNKTETFRPAGGDMRDNWRSELYKYKVVEVQPLGIA
PTGAKRRVVEREKRAVGLGALFLGFLGAAGSTMGAASITLTVQARQLLSG
IVQQQSNLLRAIEAQQHMLQLTVWGIKQLQARVLALERYLKDQQLLGIWG
CSGKLICTTNVPWNTSWSNKSETDIWGNMTWMQWEREISNYTETIYKLLE
DSQNQQERNEQDLLALDSWNSLWSWFNITKWLWYIKIFIMIVGGLIGLRI
VFAVLSIVNRVRQGYSPLSLQTLTPNPREPDRLREIEEEGGEQDRDRSIR
LVSGFLPIVWDDLRSLCLFSYHRLRDFLLLAARVVELLGHSSLRGLQRGW
EVLKYLGSLVQYWGLELKRSTISLFDTLAIAVAEGTDRIIELIQGFCRAI
RNIPTRIRQGFEASLL*
>CH0848.3.d1621.4.31
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVENSTEAMK
NCSFNTTTEIRDKIKKERALFYRPDIVPLNDETNNTSKYRLINCNTSAVT
QACPKVTFEPIPIHYCAPAGYAILKCNDETFNGTGPCSNVSTVQCTHGIR
PVVSTQLLLNGSLAEKEIVIRSENLTNNAKIIIVHLHTPVQIVCTRPYNN
TRKSVRIGPGQTFYATGDIIGDPRKAHCNISEKDWNKTLQEVGKELQKHF
PNKTIRYNQSAGGDMEITTHSFNCGGEFFYCNTSKLFNSTYNDTYISTNS
```

Figure 1 continued

```
TNSSANNSSIITLQCRIKQIINMWQGVGRAMYAPPIAGNITCKSNITGLL
LTRDGGPDNKTETFRPAGGDMRDNWRSELYKYKVVEVQPLGIAPTGAKRR
VVEREKRAVGLGALFLGFLGAAGSTMGAASITLTVQARQLLSGIVQQQSN
LLRAIEAQQHMLQLTVWGIKQLQARVLALERYLKDQQLLGIWGCSGKLIC
TTNVPWNTSWSNKSETDIWGNMTWMQWEREISNYTETIYKLLEDSQNQQE
RNEQDLLALDSWNSLWSWFNITKWLWYIKIFIMIVGGLIGLRIVFAVLSI
VNRVRQGYSPLSLQTLTPNPREPDRLREIEEEGGEQDRDRSIRLVSGFLP
IVWDDLRSLCLFSYHRLRDFLLLAARVVELLGHSSLRGLQRGWEVLKYLG
SLVQYWGLELKRSTISLFDTLAIAVAEGTDRIIELIQGFCRAIRNIPTRI
RQGFEASLL*
>CH0848.3.d1677.5.21
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVGNSTEAMK
NCSFNTTTEIRDKIKKERALFYRPDIVPLNDETNNTSKYRLINCNTSAVT
QACPKVTFEPIPIHYCAPAGYAILKCNDETFNGTGPCSNVSTVQCTHGIR
PVVSTQLLLNGSLAEKEIVIRSENLTNNVKIIIVHLHTPVQIVCTRPYNN
TRKSVRIGPGQTFYATGDIIGDPRKAHCNISEKDWNKTLQEVGKELQKHF
PNKTIRYNQSAGGDMEITTHSFNCGGEFFYCNTSKLFNSTYNDTYISTNS
TNSSANNSSIITLQCRIKQIINMWQGVGRAMYAPPIAGNITCKSNITGLL
LTRDGGPDNKTETFRPAGGDMRDNWRSELYKYKVVEVQPLGIAPTGAKRR
VVEREKRAVGLGALFLGFLGAAGSTMGAASITLTVQARQLLSGIVQQQSN
LLRAIEAQQHMLQLTVWGIKQLQARVLALERYLKDQQLLGIWGCSGKLIC
TTNVPWNTSWSNKSETDIWGNMTWMQWEREISNYTETIYKLLEDSQNQQE
RNEQDLLALDSWNSLWSWFNITKWLWYIKIFIMIVGGLIGLRIVFAVLSI
VNRVRQGYSPLSLQTLTPNPREPDRLRGIEEEGGEQDRDRSIRLVSGFLP
IVWDDLRSLCLFSYHRLRDFLLLAARVVELLGHSSLRGLQRGWEVLKYLG
SLVQYWGLELKRSTISLFDTLAIAVAEGTDRIIELIQGFCRAIRNIPTRI
RQGFEASLL*
>CH0848.3.d1621.4.44
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEKMSNVTVNN
ITIEEMKNCSFNTTTEIRDKIKKERALFYRPDIVPLNDETNNTSKYRLIN
CNTSAVTQACPKVTFEPIPIHYCAPAGYAILKCNDETFNGTGPCSNVSTV
QCTHGIRPVVSTQLLLNGSLAEKEIVIRSENLTNNAKIIIVHLHAPVEIV
CTRPYNNTRKSVRIGPGQTFYATGDIIGDPRQAHCNISKEIWNKTLQEVG
KELQKHFPNKTIRYNQSAGGDMEITTHSFNCGGEFFYCNTSNLFNSTYND
TYISPNSTNSTSIITLQCKIKQIINMWQGVGRAMYAPPIAGNITCKSNIT
GLLLTRDGGINNVSNETETFRPAGGDMRDNWRSELYKYKVVEVQPLGIAP
TGAKRRVVEREKRAVGLGALFLGFLGAAGSTMGAASITLTVQARQLLSGI
VQQQSNLLRAIEAQQHMLQLTVWGIKQLQARVLALERYLKDQQLLGIWGC
SGKLICTTNVPWNTSWSNKSETDIWNNMTWMQWEREISNYTGTIYKLLED
SQNQQERNEKDLLALDSWNSLWSWFNITKWLWYIKIFIMIVGGLIGLRIV
FAVLSIVNRVRQGYSPLSLQTLTPNPREPDRLRRIEEEGGEQDRDKSIRL
VNGFLPIVWDDLRSLCLFSYHRLRDFLLLAARVVELLGRSSLRGLQRGWE
VLKYLGSLVQYWGLELKKSAISLFDTLAVAVAEGTDRIIELIQGFCRAIR
NIPRRIRQGFEASLL*
>CH0848.3.d1635.10.55
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEISNATVKN
ITIKEMKNCSFNTTTEIRDKIKKERALFYRTDIVPLNKETGNISEYRLIN
CNTSAVTQACPKVTFEPIPIHYCAPAGYAILKCNDETFNGTGPCSNVSTV
```

Figure 1 continued

```
QCTHGIRPVVSTQLLLNGSLAEKEIVIRSENLTNNAKIIIVHLHNPVEIV
CTRPYNNTRKSVRIGPGQTFYATGDIIGDPRQAHCNISKEEWNKTLQEVG
KELQKHFPNKTIRYNQSAGGDMEITTHSFNCGGEFFYCNTSNLFNSTYND
TYISPNSTNSTSIITLQCRIKQIINMWQGVGRAMYAPPIAGNITCKSNIT
GLLLTRDGGINNVSNETETFRPAGGDMRDNWRSELYKYKVVEVQPLGIAP
TGAKRRVVERGKRAAGLGALFLGFLGAAGSTMGAASITLTVQARQLLSGI
VQQQSNLLRAIEAQQHMLQLTVWGIKQLQARVLALERYLKDQQLLGIWGC
SGKLICTTNVPWNTSWSNKSEMDIWNNMTWMQWEREISNYTGTIYKLLED
SQNQQERNEQDLLALDSWNSLWNWFDITKWLWYIKIFIMIVGGLIGLRII
FAVLSIVNRVRQGYSPLSLQTLTPNPREPDRLRGIEEEGGEQDRDKSIRL
VNGFLPIVWDDLRSLCLFSYHRLRDFLLLAARVVELLGRSSLRGLQRGWE
VLKYLGSLVQYWGLELKKSAISLFDTLAVAVAEGTDRIIEAIQGFCRAIR
NIPRRIRQGFEASLL*
```

Figure 2

```
>CH0848.3.d0135.27.03
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0107.30.12
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISANSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0107.30.31
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWSKTLQ
EVGKELQKHFPNKTIKYERSAGGDMEIATHSFNCGGEFFYCNTSNLFNGT
YNGTYISANSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0078.30.42
MRVMGILKNYPQWWIWGILGFWMLMICNGKGNLWVTVYYGVPVWKEAKTT
LFCASNAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0135.60.14
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
```

Figure 2 continued

```
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGHITCKSNIT
GLLLTRDGGTKNNSNETEETFRPAGGDMRDNWRSELYKYKVVEIQPLGIA
PTGAKRRVVEREKR
>CH0848.3.d0135.60.05
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0135.60.19
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0107.30.27
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0078.30.02
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
```

Figure 2 continued

```
YNGTYISTHSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0135.60.34
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSNSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0135.60.32
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEGQWNKTLQ
EVGKELQKHFPNKTIKYERSAGGDMEIATHSFNCGGEFFYCNTSNLFNGT
YNGTYISTNSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0135.60.20
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSNSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0194.25.21
MKVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNKTLQ
EVGKELQKHFPNKTIKYERSAGGDMEIATHSFNCGGEFFYCNTSNLFNGT
YNGTYISTNSTSSITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0194.25.24
MRVMGILKNYPQWWIWGILGFWMLMICNGKGNLWVTVYYGVPVWKEAKTT
LFCASDAKAYEKEVHNVWATHACVPTDPSPQELVLENVTENFNMWKNDMV
```

Figure 2 continued

DQMHEDIISLWDQSLKPCVKLTPLCVTLNCSNATVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISESQWNKTLQ
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0194.25.17
MRVMGILKNYPQWWIWGILGFWMLMICNGKGNLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLNCSNATVDSSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSSTNSTSNITLQCRIKQIINMWQGVGRAMYAPPIAGNITCK
SNITGLLLTRDGGTKNNSNETEETFRPAGGDMRDNWRSELYKYKVVEIQP
LGIAPTGAKRRVVEREKR
>CH0848.3.d0274.30.09
MRVRGILKNYPQWWIWGILGFWMLMICNGKGKLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLNCSNATVNSSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIVHLNTPV
EIVCTRPGNNTRKSVRIGPGQTFYATGDIIGDIRQAHCNISERQWNKTLQ
EVGKELQKHFPNKTIKYERSAGGDMEIATHSFNCGGEFFYCNTSNLFNGT
YNGTYISTNSSTNSTSNITLQCRIKQIINMWQGVGRAMYAPPIAGNITCK
SNITGLLLTRDGGTKNNSNETEETFRPAGGDMRDNWRSELYKYKVVEIQP
LGIAPTGAKRRVVEREKR
>CH0848.3.d0194.25.48
MRVMGIPKNYPQWWIWGILGFWMLMICNGKGNLWVTVYYGVPVWKEAKTT
LFCASDAKAYEKEVHNVWATHACVPTDPSPQELVLENVTENFNMWKNDMV
DQMHEDIISLWDQSLKPCVKLTPLCVTLNCSNAIVDSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLQ
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGARRRVVEREKR
>CH0848.3.d0135.27.06
MRVMGILKNYPQWWIWGILGFWMLMICNGKGKLWVTVYYGVPVWKEAKTT
LFCASDAKAYEKEVHNVWATHACVPTDPSPQELGLENVTENFNMWKNDMV
DQMHEDIISLWDQSLKPCVKLTPLCVTLKCSNAIVDSSKVYDTRSKVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKGIVIRSENLTNNAKIIIVQLNTSV
EIVCTRPGNNTRKSVRIGPGQTFYATGDIIGDIRQAHCNISEWQWNKTLH
EVGKELQKHFPNKTIKYERSAGGDMEIATHSFNCGGEFFYCNTSNLFNGT

Figure 2 continued

```
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0274.30.02
MRVMGILKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCSNATVNSSKVYDTRSNVNVT
SINNTIMGEMKNCSFNTTTEIRDKEKKEYALFYRPDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEWQWNKTLH
EVGKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0274.30.07
MRVMGIPKNYPQWWIWGILGFWILMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCSNATVDNSKVYDTRSNVNVT
SINNTIMGEMKNCSFNTTTEIRDKEKKEYALFYKPDVVPLDETSNTSEYR
LINCNTSAVTQACPKVTFEPIPIHYCAPAGYAILKCNDKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEGQWNKTLH
EVSKELQKHFPNKTIKYERSAGGDMEIATHSFNCGGEFFYCNTSNLFNGT
YNGTYINTSSTSNITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0358.80.06
MRVMGIPKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNKTFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEGQWNKTLHEVSKELQKHF
PNKTIKYERSAGGDMEIATHSFNCGGEFFYCNTSNLFNGTYNGTYINTSS
TSYITLQCRIKQIINMWQGVGRAMYAPPIAGNITCKSNITGLLLTRDGGT
KNNSNEETFRPAGGDMRDNWRSELYKYKVVEIQPLGIAPTGAKRRVVERE
KR
>CH0848.3.d0274.30.14
MRVMGILKNYLQWWIWGILGFWMLMICKGKGNLWVTVYYGVPVWKEAKTT
LFCASDAKAYEKEVHNVWATHACVPTDPSPQELVLENVIENFNMWKNDMV
DQMHEDIISLWDQSLKPCVKLTPLCVTLTCSNATVDNSKVYDTRSNVNVT
SINNTIMGEMKNCSFNTTTEIRDKEKKEYALFYRSDVVPLDETSNTSEYR
LINCNTSAVTQACPKVTFEPIPIHYCAPAGYAILKCNNKTFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISERQWYKTLQ
EVGKELQKHFPNKTIKYERSAGGDMEIATHSFNCGGEFFYCNTSNLFNGT
YNGTYISINSTSYITLQCRIKQIINMWQGVGRAMYAPPIAGNITCKSNIT
GLLLTRDGGTKNNSNETEETFRPAGGDMRDNWRSELYKYKVVEIQPLGIA
PTGAKRRVVEREKR
>CH0848.3.d0358.80.44
MRVMGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
```

Figure 2 continued

DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNKTFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEEKWNKTLQEVGKELQKHF
PNKTIKYERSAGGDMEIATHSFNCGGEFFYCNTSNLFNGTYNGTDISTNS
NSTITLQCRIKQIINMWQGVGRAMYAPPIAGNITCKSNITGLLLTRDGGT
KNNSNEETFRPAGGDMRDNWRSELYKYKVVEIQPLGIAPTGAKRRVVERE
KR
>CH0848.3.d0358.80.03
MKVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLNCSNARSNVNVTSINNTIMGEM
KNCSFNTTTEIRDKEKKEYALFYKPDVVPLNETSNTSEYRLINCNTSAVT
QACPKVTFEPIPIHYCAPAGYAILKCNNETFNGTGPCSNVSTVQCTHGIR
PVVSTQLLLNGSLAEKEIVIRSENLTNNAKIIIVHLNTPVEIVCTRPGNN
TRKSVRIGPGQTFYATGDIIGDIRQAHCNISEGQWNKTLQEVGKELQKHF
PNKTIKYERSAGGDMEITTHSFNCGGEFFYCNTSNLFNGTYNGTYINIST
NSNSTITLQCRIKQIINMWQGVGRAMYAPPIAGNITCKSNITGLLLTRDG
GTKNNSNEETFRPAGGDMRDNWRSELYKYKVVEIQPLGIAPTGAKRRVVE
REKR
>CH0848.3.d0358.80.17
MRVMGILKNYPQWWIWGILGFWMLMNCNGKGNLWVTVYYGVPVWKEAKTT
LFCASDAKAYKKEVHNVWATHACVPTDPSPQELVLENVTENFNMWKNDMV
DQMHEDIISLWDQSLKPCVKLTPLCVTLNCSNARSNVNVTSINNTIMGEM
KNCSFNTTTEIRDKEKKEYALFYRPDVVPLNETSNTSEYRLINCNTSAVT
QACPKVTFEPIPIHYCAPAGYAILKCNNETFNGTGPCSNVSTVQCTHGIR
PVVSTQLLLNGSLAEKEIVIRSENLTNNAKIIIVHLNTSVEIVCTRPGNN
TRKSVRIGPGQTFYATGDIIGDIRQAHCNISEEKWNKTLQQVGKELQKHF
PNKTIKYERSAGGDMEITTHSFNCGGEFFYCNTSNLFNGTYNGTYINIST
NSNSTITLQCRIKQIINMWQGVGRAMYAPPIAGNITCKSNITGLLLTRDG
GTKNNSNEETFRPAGGDMRDNWRSELYKYKVVEIQPLGIAPTGAKRRVVE
REKR
>CH0848.3.d0445.30.41
MRVMGILKNYPQWWIWGILGFWMLMICKGKGNLWVTVYYGVPVWKEAKTT
LFCASDAKAYEKEMHNVWATHACVPTDPSPQELFLENVTENFNMWKNDMV
DQMHEDIISLWDQSLKPCVKLTPLCVTLNCSNVSNVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLNTSVEIVCTRPGNNT
RKSVRIGPGQTFYATGDIIGDIRQAHCNISEEKWNKTLQQVGKELQKHFP
NKTIKYERSAGGDMEIATHSFNCGGEFFYCNTSNLFNGTYNGTYSTNSTS
TITLQCRIKQIINMWQGVGRAMYAPPIAGNITCKSNITGLLLTRDGGTKN
NSNEETFRPAGGDMRDNWRSELYKYKVVEIQPLGIAPTGAKRRVVEREKR

>CH0848.3.d0445.25.04
MRVMGIPKNYPQWWIWGILGFWMLMNCNGKGNLWVTVYYGVPVWKEAKTT
LFCASDAKAYKKEVHNVWATHACVPTDPSPQELVLDNVTENFNMWKNDMV
DQMHEDIISLWDQSLKPCVKLTPLCVTLNCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKGIVIRSENLTNNAKIIIVQLNTSVEIVCTRPGNNT
RKSVRIGPGQTFYATGDIIGDIRQAHCNISEEKWNKTLHEVSKELQKHFP
NKTIKYERSAGGDMEIATHSFNCGGEFFYCNTSKLFNGTYNGTYISTNST

Figure 2 continued

```
SYITLQCRIKQIINMWQGVGRAMYAPPIAGNITCKSNITGLLLTRDGGTN
NNSNEETFRPAGGDMRDNWRSELYKYKVVEIQPLGIAPTGAKRRVVEREK
R
>CH0848.3.d0445.30.42
MRVMGILKNYPPWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLNCSNVNVVNVTNITNTIKGEMK
NCSFNTTTEIRDKEKKEYALFYKPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLNTSVEIVCTRPGNNT
RKSVRIGPGQTFYATGDIIGDIRQAHCNISEEKWNKTLHEVSKELQKHFP
NKTIKYERSAGGDMEIATHSFNCGGEFFYCNTSNLFNGTYNGTYISTNSS
ANSNSTITLQCRIKQIINMWQGVGRAMYAPPIAGNITCKSNITGLLLTRD
GGTKNNSNEETFRPAGGDMRDNWRSELYKYKVVEIQPLGIAPTGAKRRVV
EREKR
>CH0848.3.d0445.25.26
MRVMGILKNYPQWWIWGILGFWMLMICNGKGKLWVTVYYGVPVWKEAKTT
LFCASDAKAYEKEVHNVWATHACVPTDPSPQELVLKNVTENFNMWKNDMV
DQMHEDIISLWDQSLKPCVKLTPLCVTLDCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLNTPVEIVCTRPGNNT
RKSVRIGPGQTFYATGDIIGDIRQAHCNISEKQWNETLQKVGKELQKHFP
NKTIKYERSAGGDMEITTHSFNCGGEFFYCNTSNLFNGTYNGTYINISTN
SNSTITLQCRIKQIINMWQGVGRAMYAPPIAGNITCRSNITGLLLTRDGG
TKNNSNEETFRPAGGDMRDNWRSELYKYKVVEIQPLGIAPTGAKRRVVER
EKR
>CH0848.3.d0526.25.21
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLNCVNVTNITNTIKGEMKNCSFN
TTTEIRDKEKKEYALFYRPDVVPLNETSNTSEYRLINCNTSAVTQACPKV
TFEPIPIHYCAPAGYAILKCNNETFNGTGPCSNVSTVQCTHGIRPVVSTQ
LLLNGSLAEKGIVIRSENLTNNAKIIIVQLNTSVEIVCTRPGNNTRKSVR
IGPGQTFYATGDIIGDIRQAHCNISEEKWNKTLQQVGKELQKHFPNKTIK
YERSAGGDMEITTHSFNCGGEFFYCNTSNLFNGTYNGTYNGTNSNSTITL
QCRIKQIINMWQGVGRAMYAPPIAGNITCRSNITGLLLTRDGGTNSNKTE
ETFRPAGGDMRDNWRSELYKYKVVEIQPLGIAPTGAKRRVVEREKR
>CH0848.3.d0526.25.10
MRVMGIPKNYPQWWIWGILGFWMLMNCNGKGNLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLNCSNVNVVNVTNITNTIKGEMK
NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLHTPVEIVCTRPGNNT
RKSVRIGPGQTFYATGDIIGDIRQAHCNISEEKWNKTLQQVGKELQKHFP
NKTIKYERSAGGDMEITTHSFNCGGEFFYCNTSNLFNGTYNGKYINISTN
SNSTITLQCRIKQIINMWQGVGRAMYAPPIAGNITCKSNITGLLLTRDGG
TKNNSTETEETFRPAGGDMRDNWRSELYKYKVVEIQPLGIAPTGAKRRVV
EREKR
>CH0848.3.d0445.25.18
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLNCSNVNVVNVTNITNTIKGEMK
```

Figure 2 continued

NCSFNTTTEIRDKEKKEYALFYRPDVVPLNETSNTSEYRLINCNTSAVTQ
ACPKVTFEPIPIHYCAPAGYAILKCNNETFNGTGPCSNVSTVQCTHGIRP
VVSTQLLLNGSLAEKEIVIRSENLTNNAKIIIVHLHTPVEIVCTRPGNNT
RKSVRIGPGQTFYATGDIIGDIRQAHCNISEEKWNKTLQEVGKELQKHFP
NKTIKYERSAGGDMEITTHSFNCGGEFFYCNTSNLFNGTYNGPYINISTN
SNSTITLQCRIKQIINMWQGVGRAMYAPPIAGNITCKSNITGLLLTRDGG
TKNNSNEETFRPAGGDMRDNWRSELYKYKVVEIQPLGIAPTGAKRRVVER
EKR
>CH0848.3.d0526.25.02
MKVMGILKNYPQWWIWGILGFWMLMICKGKGNLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLICSNATVNNRTAYDTRSNVNVT
SINNTIMGEMKNCSFNTTTEIRDKEKKEYALFYKPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTSV
EIVCTRPGNNTRKSVRIGPGQTFYATGDIIGDIRQAHCNISEKQWNETLQ
KVGKELQKHFPNKTIKYERSAGGDMEIATHSFNCGGEFFYCNTSKLFNGT
YNGTDINISTNSNSTITLQCRIKQIINMWQGVGRAMYAPPIAGNITCKSN
ITGLLLTRDGGTNSNKTEETFRPAGGDMRDNWRSELYKYKVVEIQPLGIA
PTGAKRRVVEREKR
>CH0848.3.d0526.25.26
TRVMGILKNYPQWWIWGILGFWMLMICNGKGNLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLNCSNVNVTRSNVNVTNITNTIK
GEMKNCSFNTTTEIRDKEKKEYALFYRSDVVPLNETSNTSEYRLINCNTS
AVTQACPKVTFEPIPIHYCAPAGYAILKCNNETFNGTGPCSNVSTVQCTH
GIRPVVSTQLLLNGSLAEKEIVIRSENLTNNAKIIIVHLHTPVEIVCTRP
GNNTRKSVRIGPGQTFYATGDIIGDIRQAHCNISEEKWNKTLHEVSKELQ
KHFPNKTIKYAQSAGGDMEITTHSFNCGGEFFYCNTSNLFNGTYNGTYIS
TNSSANSNSTITLQCRIKQIINMWQGVGRAMYAPPIAGNITCRSNITGLL
LTRDGGTKNNKTEETFRPAGGDMRDNWRSELYKYKVVEIQPLGIAPTGAK
RRVVEREKR
>CH0848.3.d0526.25.09
MRVMGILKNYPQWWIWGILGFWMLMICNGKGKLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLNCSNVNVTGSNVNVTNITNTIT
GEMKNCSFNTTTEIRDKEKKEYALFYKPDVVPLNETSNTSEYRLINCNTS
AVTQACPKVTFEPIPIHYCAPAGYAILKCNNETFNGTGPCSNVSTVQCTH
GIRPVVSTQLLLNGSLAEKGIVIRSENLTNNAKIIIVQLNTSVEIVCTRP
GNNTRKSVRIGPGQTFYATGGIIGDIRQAHCNISESKWNETLHEVSKELQ
KHFPNKTIKYERSAGGDMEITTHSFNCGGEFFYCNTSNLFNGTYNGTYNG
TNSNSTITLQCRIKQIINMWQGVGRAMYAPPIAGNITCRSNITGLLLTRD
GGTNSNKTEETFRPAGGDMRDNWRSELYKYKVVEIQPLGIAPTGAKRRVV
EREKR
>CH0848.3.d0526.25.39
MRVMGIPKNYPQWWIWGILGFWMLMICSGRGNLWVTVYYGVPVWKEAKTT
LFCASDAKAYEKEMHNVWATHACVPTDPSPQELFLENVTENFNMWKNDMV
DQMHEDIISLWDQSLKPCVKLTPLCVTLICSNATVNNRTVYDTRSNVNVT
SINNTIMGEMKNCSFNTTTEIRDKEKKEYALFYKPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTPV
EIVCTRPGNNTRKSVRIGPGQTFYATGDIIGDIRQAHCNISEEKWNKTLQ
KVGKELQKHFPNKTIKYERSAGGDMEITTHSFNCGGEFFYCNTSKLFNGT
YNGINISTNSNSTITLQCRIKQIINMWQGVGRAMYAPPIAGNITCKSNIT

Figure 2 continued

```
GLLLTRDGGNRNNSNEETFRPAGGDMRDNWRSELYKYKVVEIQPLGIAPT
GAKRRVVEREKR
>CH0848.3.d0526.25.32
MRVMGIPKNYPQWWIWGILGFWMLMNCNGKENLWVTVYYGVPVWKEAKTT
LFCASDARAYEKEVHNVWATHACVPTDPSPQELFLENVTENFNMWKNDMV
DQMHEDIISLWDQSLKPCVKLTPLCVTLICSNATVNNRTVYDTRSNANVT
SINNTIMGEMKNCSFNTTTEIRDKEKKEYALFYRPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLHTPV
EIVCTRPGNNTRKSVRIGPGQTFYATGDIIGDIRQAHCNISEEKWNKTLQ
KVGKELQKHFPNKTIKYERSAGGDMEITTHSFNCGGEFFYCNTSNLFNGT
YNGTYNGTNSNSTITLQCRIKQIINMWQGVGRAMYAPPIAGNITCRSNIT
GLLLTRDGGTNSNKTEETFRPAGGDMRDNWRSELYKYKVVEIQPLGIAPT
GAKRRVVEREKR
>CH0848.3.d0526.25.11
MRVMGILKNCPQWWIWGILGFWMLMICNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLICSNATVNNRTVYDTRSNVSVT
SINNTIMGEMKNCSFNTTTEIRDKEKKEYALFYRPDIVPLNETSNTSEYR
LINCNTSAVTQACPKVTFEPIPIHYCAPAGYAILKCNNETFNGTGPCSNV
STVQCTHGIRPVVSTQLLLNGSLAEKEIVIRSENLTNNAKIIIVHLNTPV
EIVCTRPSNNTRKSVRIGPGQTFYATGDIIGDIRQAHCNISEEKWNKTLQ
KVGKELQKHFPNKTIKYERSAGGDMEITTHSFNCGGEFFYCNTSNLFNGT
YNGTYTNISTNSNSTITLQCRIKQIINMWQGVGRAMYAPPIAGNITCRSN
ITGLLLTRDGGTNSNKTEETFRPAGGDMRDNWRSELYKYKVVEIQPLGIA
PTGAKRRVVEREKR
>CH0848.3.d0611.20.12
MRVMGIPKNYPQWWIWGILGFWMLMNCNGKGNLWVTVYYGVPVWKEAKTT
LFCASDAKAYKKEVHNVWATHACVPTDPSPQELFLENVTENFNMWKNDMV
DQMHEDIISLWDQSLKPCVKLTPLCVTLICSNATVNNRTMGEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPGNNTRKSVRI
GPGQTFYATGAIIGDIRQAHCNISESKWNETLQKVGKELQKHFPNKTIKY
EQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKR
>CH0848.3.d0700.27.06
MRVMGILKNYPQWWIWGILGFWMLMICKGKGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSNATVNNRTVYEMKNCSFNT
TTEIRDKEKKEYALFYRSDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLHTPVEIVCTRPGNNTRKSVRI
GPGQTFYATGDIIGEIRQAHCNISESKWNETLQKVGKELQKHFPNKTIKY
ERSAGGDMEITTHSFNCGGEFFYCNTSKLFNGTYNGTDISTNSSANSNST
ITLQCRIKQIINIWQGVGRAMYAPPIAGNITCKSNITGLLLTRDGGNNNN
RNEETFRPAGGDMRDNWRSELYKYKVVEIQPLGIAPTGAKRRVVEREKR

>CH0848.3.d1305.10.30
MRVTGILKNYPQWWIWGILGFWMLTCNGEGNLWVTVYYGVPVWKEAKTT
LFCASDAKAYKKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVPLDETNNTSEYRLINCNTSAVTQACPKVT
```

Figure 2 continued

```
FEPIPIHYCAPAGYAILKCNDETFNGTGPCSNVSTVQCTHGIRPVVSTQL
LLNGSLAEKEIVIRSENLTNNAKIIIVHLHTPVEIVCTRPGHNTRKSVRI
GPGQTFYATGDIIGDIRQAHCNINESEWNETLQKVGKELQKHFPNKTIKY
EQSAGGDMEITTHSFNCGGEFFYCNTAELFNGTYNGTDISTNSSANSTST
ITLQCRIKQIINMWQGVGRAMYAPPIAGNITCRSNITGLLLTRDGGINNV
SNETETFRPAGGDMRDNWRSELYKYKVVEVQPLGIAPTGAKRRVVEREKR

>CH0848.3.d1432.5.50
MRVTGILKNYPQWWIWGILGFWMLMNCNGEGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVPLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPGHNTRKSVRI
GPGQTFYATGDIIGDIRQAHCNINESKWNETLQKVGNELQKHFPNKTIKY
EQAAGGDMEITTHSFNCGGEFFYCNTANLFNGTYNGTDISTNSSANSTST
ITLQCKIKQIINMWQGVGRAMYAPPIAGNITCRSNITGLLLTRDGGINNV
SNETETFRPAGGDMRDNWRSELYKYKVVEVQPLGIAPTGAKRRVVEREKR

>CH0848.3.d1621.4.25
MRVTGILKNYPQWWIWGILGFWMLMNCNGEGNLWVTVYYGVPVWKEAKTT
LFCASDAKAYEKEVHNVWATHACVPTDPSPQELFLENVTENFNMWKNDMV
DQMHEDIISLWDQSLKPCVKLTPLCVTLICSTATVNNSTVDEMKNCSFNA
TTEIRDKKKKEYALFYRSDVVSLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKTIIVHLHAPVEIVCTRPGHNTRKSVRI
GPGQTFYATGDIIGNIRQAHCNINESEWNETLQKVGKELRKHFPNKTIKY
EQSAGGDMEITTHSFNCGGEFFYCNTANLFNGTYNGTDISTNSSADRNST
ITLECKIKQIINMWQGVGRAMYAPPIAGNITCRSNITGLLLTRDGGINNV
SNATETFRPAGGDMRDNWRSELYKYKVVEVQPLGIAPTGAKRRVVEREKR

>CH0848.3.d0611.9.02
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNDMV
DQMHEDIISLWDQSLKPCVKLTPLCVTLICSNATVNNRTVYEMKNCSFNT
TTEIRDKEKKEYALFYRPDIVPLGETSNTSEYRLINCNTSAVTQACPKVT
FEPIPIHYCAPAGYAILKCNNETFNGTGPCSNVSTVQCTHGIRPVVSTQL
LLNGSLAEKGIVIRSENLTNNAKIIIVHLHTPVEIVCTRPGNNTRKSVRI
GPGQTFYATGDIIGDIRQAHCNISEEKWNETLQKVGKELQKHFPNKTIKY
AQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKR
>CH0848.3.d0611.20.28
MRVMGILKNCPQWWIWGILGFWMLMICNGKGKLWVTVYYGVPVWKEAKTT
LFCASDARAYEKEVHNVWATHACVPTDPSPQELVLDNVTENFNMWKNDMV
DQMHEDIISLWDQSLKPCVKLTPLCVTLICSNATVNNRTVYEMKNCSFNT
TTEIRDKEKKEYALFYRPDIVPLNETSNTSEYRLINCNTSAVTQACPKVT
FEPIPIHYCAPAGYAILKCNNKTFNGTGPCSKVSTVQCTHGIRPVVSTQL
LLNGSLAEKEIVIRSENLTNNAKIIIVHLHTPVEIVCTRPGNNTRKSVRI
GPGQTFYATGDIIGDIRQAHCNISEEKWNETLQKVGKELQKHFPNKTIKY
AQSAGGDMEITTHSFNCGGEFFYCNTSKLFNGTYNGAYINISTNSNSTIT
LQCRIKQIINMWQGVGRAMYAPPIAGNITCKSNITGLLLTRDGGTNNKTE
EIFRPAGGDMRDNWRSELYKYKVVEIQPLGIAPTGAKRRVVEREKR
>CH0848.3.d0611.20.14
```

Figure 2 continued

```
MKVMGIPKNYPQWWIWGILGFWMLMNCNGKENLWVTVYYGVPVWKEAKTT
LFCASDAKAYKKEVHNVWATHACVPTDPSPQELVLGNVTENFNMWKNDMV
DQMHEDIISLWDQSLKPCVKLTPLCVTLICSNATVNNRTVYEMKNCSFNT
TTEIRDKEKKEYALFYRPDIVPLNETSNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLHTPVEIVCTRPGNNTRKSVRI
GPGQTFYATGDIIGDIRQAHCNISEKQWNETLQKVGKELQKHFPNKTIKY
ERSAGGDMEITTHSFNCGGEFFYCNTSKLFNGTYNGTDISTNSSANSNST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKR
>CH0848.3.d0700.15.29
MRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNENETSNTSE
YRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHT
PVEIVCTRPGNNTRKSVRIGPGQTFYATGDIIGDIRQAHCNISEEKWNET
LQKVGKELQKHFPNKTIKYAQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNNTSNEETFRPAGGDMRDNWRSELYKYKVVEIQP
LGIAPTGAKRRVVEREKR
>CH0848.3.d0700.15.34
TRVMGILKNYPQWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVNNRTMGEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGGIIGDIRQAHCNISEGQWNETLQKVGKELQKHFPNKTIKY
EQSAGGDMEITTHSFNCGGEFFYCNTSKLFNGTYNGTYISTNSSTNSIST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKR
>CH0848.3.d0700.15.06
MRVMGIPKNYPQWWIWGILGFWMLMNCNGKENLWVTVYYGVPVWKEAKTT
LFCASDAKAYKKEVHNVWATHACVPTDPSPQELVLKNVTENFNMWKNNRV
DQMHEDIISLWDQSLKPCVKLTPLCVTLICSNATVDNRTVGEMKNCSFNT
TTEIRDKEKKEYALFYKPDVVPLDETNNTSEYRLINCNTSAVTQACPKVT
FEPIPIHYCAPAGYAILKCNNETFNRTGPCSNVSTVQCTHGIRPVVSTQL
LLNGSLAEKEIVIRSENLTNNAKIIIVHLNTPVEIVCTRPNNNTRKSVRI
GPGQTFYATGGIIGDIRQAHCNISEGQWNETLQKVGKELQKHFPNKTIKY
EQSAGGDMEITTHSFNCGGEFFYCNTSKLFNGTYNGTYISTNSSTNSIST
ITLQCRIKQIINMWQGVGRAMYAPPIAGNITCKSNITGLLLTRDGGTNSS
EEIFRPAGGDMRDNWRSELYKYKVVEIQPLGIAPTGAKRRVVEREKR
>CH0848.3.d0700.15.15
MRVTGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNETSNTSEYR
LINCNTSAVTQACPKVTFEPIPIHYCAPAGYAILKCNDETFNGTGPCSNV
STVQCTHGIRPVVSTQLLLNGSLAEKEIVIRSENLTNNAKIIIVHLHTPV
EIVCTRPGNNTRKSVRIGPGQTFYATGDIIGDIRQAHCNISEEKWNKTLQ
KVGKELQKHFPNKTIKYERPAGGDLEITTHSFNCGGEFFYCNTSKLFNGT
YNGTDISTNSSTNSTSTITLQCRIKQIINMWQGVGRAMYAPPIAGNITCK
```

Figure 2 continued

SNITGLLLTRDGGTNSSEEIFRPAGGDMRDNWRSELYKYKVVEIQPLGIA
PTGAKRRVVEREKR
>CH0848.3.d0780.25.05
TRVMGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVNNRTDYDTRSNVNVT
NITNTIKGEMKNCSFNTTTEIRDKEKKEYALFYRPDIVPLNENETSNTSE
YRLINCNTSAVTQACPKVTFEPIPIHYCAPAGYAILKCNDETFNGTGPCS
NVSTVQCTHGIRPVVSTQLLLNGSLAEKEIVIRSENLTNNAKIIIVHLNT
SVEIVCTRPGNNTRKSVRIGPGQTFYATGDIIGDIRQAHCNISESKWNET
LQKVGIELQKHFPNKTIKYEQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNSSEEIFRPAGGDMRDNWRSELYKYKVVEIQPLG
IAPTGAKRRVVEREKR
>CH0848.3.d0700.15.05
TRVMGILKNYPQWWIWGILGFWMLMICNGKGKLWVTVYYGVPVWKEAKTT
LFCASDAKAYKKEVHNVWATHACVPTDPSPQELVLGNVTENFNMWKNDMV
DQMHEDIISLWDQSLKPCVKLTPLCVTLICSNATVNNRTVYDSRSNDNVT
SINNTIMGEMKNCSFNTTTEIRDKEKKEYALFYRPDIVPLNENETSNTSE
YRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHT
PVEIVCTRPGNNTRKSVRIGPGQTFYATGDIIGDIRQAHCNISEEKWNET
LQKVGIELQKHFPNKTIKYEQSAGGDMEITTHSFNCGGEFFYCNTSNLFN
GTYNGTYISTNSSANSTSTITLQCRIKQIINMWQGVGRAMYAPPIAGNIT
CKSNITGLLLTRDGGTNNTSNEETFRPAGGDMRDNWRSELYKYKVVEIQP
LGIAPTGAKRRVVEREKR
>CH0848.3.d0794.5.41
MRVMGILKNYPQWWIWGILGFWMLMICNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNRTVEEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLLNGSLAEKEIVIRSENLTNNAKIIIVHLNTPVEIVCTRPNNNTRKSVR
IGPGQTFYATGDIIGDIRQAHCNISEKEWNDTLQKVGKELQKHFPNKTIE
YKQSAGGDMEITTHSFNCGGEFFYCNTSNLFNGTYNGTYMNISTDSNSTI
TLQCRIKQIINMWQGVGRAMYAPPIAGNITCRSNITGLLLTRDGGTNSSK
TEEETFRPAGGDMRDNWRSELYKYKVVEIQPLGIAPTGAKRRVVEREKR

>CH0848.3.d0794.3.03
TRVMGILKNYPQWWIWGILGFWMLMICNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVDNRTVGEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLLNGSLAEKGIVIRSENLTNNAKIIIVQLNTSVEIVCTRPNNNTRKSVR
IGPGQTFYATGDIIGEIRQAHCNISEEKWNETLQKVGKELQKHFPNKTIK
YAQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR

>CH0848.3.d0836.10.36
MRVMGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT

Figure 2 continued

```
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVHLHTPVEIVCTRPNNNTRKSVR
IGPGQTFYATGDIIGDIRQAHCNISESKWNETLQKVGKELQKHFPNKTIK
YEQSAGGDMEITTHSFNCGGEFFYCTTSKLFNGTYNGTDISTNSSANSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR

>CH0848.3.d0836.10.31
TRVMGILKNYPQWWIWGILGFWMLMICNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVHLHTPVEIVCTRPNNNTRKSVR
IGPGQTFYATGDIIGDIRQAHCNISESKWNETLQKVGKELQKHFPNKTIK
YAQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGTNS
SGKEEIFRPAGGDMRDNWRSELYKYKVVEIQPLGIAPTGAKRRVVEREKR

>CH0848.3.d0808.15.27
TRVMGILKNYPQWWIWGILGFWMLMICNGKGKLWVTVYYGVPVWKEAKTT
LFCASDARAYEKEVHNVWATHACVPTDPSPQELFLDNVTENFNMWKNDMV
DQMHEDIISLWDQSLKPCVKLTPLCVTLICSNATVKNRTVYEMKNCSFNT
TTEIRDKEKKEYALFYRPDIVPLNENETSNTSEYRLINCNTSAVTQACPK
VTFEPIPIHYCAPAGYAILKCNNETFNGTGPCSNVSTVQCTHGIRPVVST
QLLLNGSLAEKEIVIRSENLTNNAKIIIVHLNTPVEIVCTRPNNNTRKSV
RIGPGQTFYATGDIIGDIRQAHCNISEKEWNETLQKVGKELQKHFPNKTI
KYEQSAGGDMEITTHSFNCGGEFFYCNTSNLFNGTYNGTDISTNSSAKSN
STITLQCRIKQIINMWQGVGRAMYAPPIAGNITCKSNITGLLLTRDGGNS
SKTEEETFRPAGGDMRDNWRSELYKYKVVEIQPLGIAPTGAKRRVVEREK
R
>CH0848.3.d0864.7.39
MRVMGIPKNCPQWWIWGILGFWMLMICNGKGKLWVTIYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLNTPVEIVCTRPNNNTRKSVR
IGPGQTFYATGDIIGDIRQAHCNISEKEWNDTLQKVGKELQKHFPNKTIE
YKQSAGGDMEITTHSFNCGGEFFYCNTAKLFNGTYNGTDISTNSSADSNS
TITLQCRIKQIINMWQGVGRAMYAPPIAGNITCKSHITGLLLTRDGGTNS
SEEEEIFRPAGGDMRDNWRSELYKYKVVEIQPLGIAPTGAKRRVVEREKR

>CH0848.3.d0864.7.26
MRVTGILKNYPQWWIWGILGFWMLMNCNGKENLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNSTVDEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLNTPVEIVCTRPNNNTRKSV
RIGPGQTFYATGDIIGDIRQAHCNISEKEWNETLQKVGKELQKHFPNKTI
KYAQSAGGDMEITTHSFNCGGEFFYCNTANLFNGTYNGTDISTNSSTKSN
STITLQCRIKQIINMWQGVGRAMYAPPIAGNITCRSTITGLLLTRDGGNN
```

Figure 2 continued

```
SSKTEEETFRPAGGDMRDNWRSELYKYKVVEIQPLGIAPTGAKRRVVERE
KR
>CH0848.3.d0794.5.27
MRVMGIPKNYPQWWIWGILGFWMLMNCNGKENLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVDNRTVGEMKNCSFNT
TTEIRDKEKKEYALFYRPDIVPLSETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGEIKQAHCNISEEKWNETLQKVGKELQKHFPNKIIKY
AQSAGGDMEITTHSFNCGGEFFYCNTANLFNGTYNGTDISTNSSTKSNST
ITLQCRIKQIINMWQGVGRAMYAPPIAGNITCRSTITGLLLTRDGGTNSS
KTEEETFRPAGGDMRDNWRSELYKYKVVEIQPLGIAPTGAKRRVVEREKR

>CH0848.3.d0949.10.18
TRVMGILKNYPQWWIWGILGFWMLMICNGKGKLWVTVYYGVPVWKEAKTT
LFCASDARAYEKEVHNVWATHACVPTDPSPQELFLDNVTENFNMWKNDMV
DQMHEDIISLWDQSLKPCVKLTPLCVTLICSTATVDNSTVEEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLHTPVEIVCTRPNNNTRKSV
RIGPGQTFYATGDIIGEIRQAHCNISEEEWNETLQKVGKELQKHFPNKTI
KYEQSAGGDMEITTHSFNCGGEFFYCNTANLFNGTYNGTDISTNSSTKSN
STITLQCRIKQIINMWQGVGRAMYAPPIAGNITCKSNVTGLLLTRDGGTN
SSQTEEETFRPAGGDMRDNWRSELYKYKVVEIQPLGIAPTGAKRRVVERE
KR
>CH0848.3.d0808.15.25
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNATVKNRTVEEMKNCSFNT
TTEIRDKEKKEYALFYRPDIVPLNENETSNTSEYRLINCNTSAVTQACPK
VTFEPIPIHYCAPAGYAILKCNDETFNGTGPCSNVSTVQCTHGIRPVVST
QLLLNGSLAEKEIVIRSENLTNNAKIIIVHLNAPVEIVCTRPNNDTRKSV
RIGPGQTFYATGDIIGDIRQAHCNISEKEWNETLQKVGIELQKHFPNKTI
KYEQSAGGDMEITTHSFNCGGEFFYCNTSKLFNGTYNGTYINTSSNSTIT
LQCRIKQIINMWQGVGRAMYAPPIAGNITCKSDITGLLLTRDGGTNSSGK
EEIFRPAGGDMRDNWRSELYKYKVVEIQPLGIAPTGAKRRVVEREKR
>CH0848.3.d0864.3.03
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNTVNNRTVYEMKNCSFNTT
TEIRDKEKKEYALFYRPDIVPLNENETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR
IGPGQTFYATGDIIGEIRQAHCNISEKEWNETLQKVGKELQKHFPNKTIK
YAQSAGGDMEITTHSFNCGGEFFYCNTANLFNGTYNGTDISTNSSTKSNS
TITLQCRIKQIINMWQGVGRAMYAPPIAGNITCRSTITGLLLTRDGGNSS
KTEEETFRPAGGDMRDNWRSELYKYKVVEIQPLGIAPTGAKRRVVEREKR

>CH0848.3.d0893.10.05
TRVMGILKNYPQWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNTVNNRTVYEMKNCSFNTT
TEIRDKEKKEYALFYRPDIVPLNENETSNTSEYRLINCNTSAVTQACPKV
```

Figure 2 continued

```
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR
IGPGQTFYATGDIIGEIRQAHCNISEEEWNDTLQKVGKELQKHFPNKTIE
YKQSAGGDMEITTHSFNCGGEFFYCNTAKLFNGTYNGTDISTNSSTNSNP
TITLQCRIKQIINMWQGVGRAMYAPPIAGNITCKSNITGLLLTRDGGNSS
KTEEEIFRPAGGDMRDNWRSELYKYKVVEIQPLGIAPTGAKRRVVEREKR

>CH0848.3.d0893.10.06
MRVTGILKNYPQWWIWGILGFWMLMNCNGKENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNATVKNSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGDTRQAHCNISEKKWNETLQKVGIELQKHFPNKTIK
YNQSAGGDMEITTHSFNCGGEFFYCNTSNLFNGTYNGTYISTNSSANSTS
TITLQCRIKQIINMWQGVGRAMYAPPIAGNITCRSNITGLLLTRDGGTNS
NETETFRPAGGDMRDNWRSELYKYKVVEIQPLGIAPTGAKRRVVEREKR

>CH0848.3.d0949.10.10
TRVMGILKNYPQWWIWGILGFWMLMNCNGEGNLWVTVYYGVPVWKEAKTT
LFCASDAKAYKKEVHNVWATHACVPTDPSPQELFLDNVTENFNMWKNDMV
DQMHEDIISLWDQSLKPCVKLTPLCVTLICSNATVENKTVEEMKNCSFNT
TTEIRDKEKKEYALFYKPDVVPLDETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPNNNTRKSVRI
GPGQTFYATGDIIGDIKQAHCNISEKKWNETLQKVGIELQKHFPNKTIKY
NQSAGGDMEITTHSFNCGGEFFYCNTSNLFNGTYNGTYISTNSSANSTST
ITLQCRIKQIINMWQGVGRAMYAPPIAGNITCRSNITGLLLTRDGGTNSN
ETETFRPAGGDMRDNWRSELYKYKVVEIQPLGIAPTGAKRRVVEREKR
>CH0848.3.d0949.10.17
TRVMGILKNYPQWWIWGILGFWMLMICNGKGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNGTVEEMKNCSFNT
TTEIRDKEKKEYALFYKPDIVPLSETNNTSEYRLINCNTSAVTQACPKVT
FEPIPIHYCAPAGYAILKCNDETFNGTGPCSNVSTVQCTHGIRPVVSTQL
LLNGSLAEKEIVIRSENLTNNAKIIIVHLHTPVEIVCTRPNNNTRKSVRI
GPGQTFYATGDIIGDIKQAHCNISEEKWNDTLQKVGIELQKHFPNKTIKY
NQSAGGDMEITTHSFNCGGEFFYCNTSNLFNGTYNGTYISTNSSANSTST
ITLQCRIKQIINMWQGVGRAMYAPPIAGNITCRSNITGLLLTRDGGTNSN
ETETFRPAGGDMRDNWRSELYKYKVVEIQPLGIAPTGAKRRVVEREKR
>CH0848.3.d0808.15.15
TRVMGILKNYPQWWIWGILGFWMLMICNGKGKLWVTVYYGVPVWKEAKTT
LFCASDARAYEKEVHNVWATHACVPTDPSPQELFLKNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
GKEEIFRPAGGDMRDNWRSELYKYKVVEIQPLGIAPTGAKRRVVEREKR

```
TRVMGILKNYPQWWIWGILGFWMLMICNGKGKLWVTVYYGVPVWKEAKTT
LFCASDARAYEKEVHNVWATHACVPTDPNPQELVLGNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
EKEEIFRPAGGDMRDNWRSELYKYKVVEIQPLGIAPTGAKRRVVEREKR

>CH0848.3.d0780.15.29
TRVMGIPKNYPQWWIWGILGFWMLMICNGKGKLWVTVYYGVPVWKEAKTT
LFCASDAKAYKKEVHNVWATHACVPTDPNPQELVLGNVTENFNMWKNDMV
DQMHEDIISLWDQSLKPCVKLTPLCVTLICSNATVKNRTVEEMKNCSFNT
TTEIRDKEKKEYALFYKPDVVPLDETNNTSEYRLINCNTSAVTQACPKVT
FEPIPIHYCAPAGYAILKCNNETFNGTGPCSNVSTVQCTHGIRPVVSTQL
LLNGSLAEKEIVIRSENLTNNAKIIIVHLNTPVEIVCTRPNNNTRKSVRI
GPGQTFYATGDIIGDIRQAHCNISEKQWNDTLQKVGKELKKHFPNKTIKY
AQSAGGDMEITTHSFNCGGEFFYCNTAKLFNGTYNGTDISTNSSADSNST
ITLQCRIKQIINMWQGVGRAMYAPPIAGNITCKSHITGLLLTRDGGTNSS
EKEEIFRPAGGDMRDNWRSELYKYKVVEIQPLGIAPTGAKRRVVEREKR

>CH0848.3.d0808.15.43
TRVMGILKNYPQWWIWGILGFWMLMICNGKGKLWVTVYYGVPVWKEAKTT
LFCASDAKAYKKEVHNVWATHACVPTDPSPQELFLKNVTENLNMWKNDMV
DQMHEDIISLWDQSLKPCVKLTPLCVTLICSNATVKNRTVEEMKNCSFNT
TTEIRDKEKKEYALFYRPDIVPLNNETSNTSEYRLINCNTSAVTQACPKV
TFEPIPIHYCAPAGYAILKCNNETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGDIRQAHCNISEKQWNDTLQKVGKELQKHFPNKTIK
YKHSAGGDMEITTHSFNCGGEFFYCNTSNLFNGTYNGTYMNISTDSNSTI
TLQCRIKQIINMWQGVGRAMYAPPIAGNITCKSHITGLLLTRDGGTNSSG
KEEIFRPAGGDMRDNWRSELYKYKVVEIQPLGIAPTGAKRRVVEREKR
>CH0848.3.d1120.10.24
MRVMGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSTATVNKSTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGGIVGDIRQAHCNISKGLWNDTLQKVGIELQKHFPNKTIK
YNQSAGGDMEITTHSFNCGGEFFYCNTSNLFNGTYNGTYISTNSSANSTS
YITLQCRIKQIINMWQGVGRAMYAPPIAGNITCRSNITGLLLTRDGGTTN
NSNETETFRPAGGDMRDNWRSELYKYKVVEIQPLGIAPTGAKRRVVEREK
R
>CH0848.3.d1120.10.05
TRVMGIPKNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSTATVNKSTVEEMKNCSFNT
TTEIRDKEKKEYALFYRPDIVPLNNKTSNTSEYRLINCNTSAVTQACPKV
TFEPIPIHYCAPAGYAILKCNDETFNGTGPCSNVSTVQCTHGIRPVVSTQ
LLLNGSLAEEEIVIRSENLTNNAKIIIVHLHTPVEIVCTRPNNNTRKSVR
IGPGQTFYATGGIIGDVRQAHCNISKGLWNDTLQKVGKELQKHFPNKTIR
```

Figure 2 continued

```
YNQSAGGDMEITTHSFNCGGEFFYCNTAKLFNGTYNGTDISTNSSANNSS
TITLQCRIKQIINMWQGVGRAMYAPPIAGNITCKSNITGLLLTRDGGINS
SREEEIFRPAGGDMRDNWRSELYKYKVVEVQPLGIAPTGAKRRVVEREKR

>CH0848.3.d1120.10.32
MRVTGILKNYPRWWIWGILGFWMLMICNGKGKLWVTVYYGVPVWKEAKTT
LFCASDAKAYEKEVHNVWATHACVPTDPSPQELVLGNVTENFNMWKNDMV
DQMHEDIISLWDQSLKPCVKLTPLCVTLICSNAIVENGTVEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKGIVIRSENLTNNAKIIIVQLNTSVEIVCTRPNNNTRKSVR
IGPGQTFYATGDIIGDPRQAHCNISKEKWNDTLQKVGKELQKHFPNKTIR
YNQSAGGDMEITTHSFNCGGEFFYCNTAKLFNSTYNGTYISTNSTNSTSN
ITLQCRIKQIINMWQGVGRAMYAPPIAGNITCRSNITGLLLTRDGGTTNN
SNETETFRPAGGDMRDNWRSELYKYKVVEIQPLGIAPTGAKRRVVEREKR

>CH0848.3.d1432.5.27
MRVTGILKNYPRWWIWGILGFWMLMNCNGEGKLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLNCSNATVNNTTDYDSRSNANVT
NITNTIKEEVKNCSFKTTTEIRDKEKKEHALFYRPDIVPLNSETGNTSEY
RLINCNTSAVTQACPKVTFEPIPIHYCAPAGYAILKCNDETFNGTGPCSK
VSTVQCTHGIRPVVSTQLLLNGSLAEKGIVIRSENLTNNAKIIIVQLNTS
VEIVCTRPGNNTRKSMRIGPGQTFYATGDIIGDIRQAHCNISESKWNDTL
QKVGIELQKHFPNKTIKYNQSAGGDMEITTHSFNCGGEFFYCNTAKLFNS
TYNGTYISTNSSANSTSKNITLQCRIKQIINMWQGVGRAMYAPPIAGNIT
CRSNITGLLLTRDGGIHNDSNETETFRPAGGDMRDNWRSELYKYKVVEIQ
PLGIAPTGAKRRVVGREKR
>CH0848.3.d1621.4.15
MRVTGILKNCPLWWIWGILGFWMLMNCNGEGNLWVTVYYGVPVWKEAKTT
LFCASDAKAYKKEVHNVWATHACVPTDPNPQEMFLKNVTENFNMWKNDMV
DQMHEDIISLWDQSLKPCVKLTPLCVTLNCSNATVNSTTDYDSRSNDSVT
NITNTIKEEVKNCSFKTTTEIRDKEKKEHALFYRPDIVPLNSETGNISEY
RLINCNTSAVTQACPKVTFEPIPIHYCAPAGYAILKCNDETFNGTGPCSN
VSTVQCTHGIRPVVSTQLLLNGSLAKEEIVIRSENLTNNAKIIIVQLNTS
VEIVCTRPGNNTRKSVRIGPGQTFYATGDIIGDIRQAHCNISEKKWNETL
QRVGIELQKHFPNKTIKYNQSAGGDMEITTHSFNCGGEFFYCNTAKLFNS
TYNGTYINTTSINSTLNITLQCRIKQIINMWQGVGRAMYAPPIAGNITCR
SNITGLLLTRDGGIHNDSNETETFRPAGGDMRDNWRSELYKYKVVEVQPL
GIAPTGAKRRVVEREKR
>CH0848.3.d1621.4.12
MRVTGILKNYPRWWIWGILGFWMLMNCNGEGKLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLNCSNATVNSTTDYDSRSNDTVT
NITNTIKEEVKNCSFKTTTEIRDKEKKEHALFYRPDIVPLNSETGNTSEY
RLINCNTSAVTQACPKVTFEPIPIHYCAPAGYAILKCNDETFNGTGPCSN
VSTVQCTHGIRPVVSTQLLLNGSLAKEEIVIRSENLTNNAKTIIVHLHTP
VEIVCTRPGNNTRKSMRIGPGQTFYATGDIIGDIRQAHCNISEEKWNKTL
QEVGKELQKHFPNRTIKYNQSAGGDMEITTHSFNCGGEFFYCNTSKLFNS
TYNDTYISTNSTNSSANNSSIITLQCRIKQIINMWQGVGRAMYAPPIAGN
IICKSNITGLLLTRDGGPDSNKTETFRPAGGDMRDNWRSELYKYKVVEVQ
PLGIAPTGAKRRVVEREKR
>CH0848.3.d1120.10.13
MRVTGILKNYPQWWIWGILGFWMLMNCNGKENLWVTVYYGVPVWKEAKTT
```

Figure 2 continued

```
LFCASDAKAYKKEVHNVWATHACVPTDPSPQELFLKNVTENFNMWKNDMV
DQMHEDIISLWDQSLKPCVKLTPLCVTLICSHATVENSTTEEMKNCSFNT
TTEIRDKEKKEYALFYRPDIVPLNNETSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGGIIGEIRQAHCNISKETWNDTLQKVGKELQKHFPNKTIR
YNQSAGGDMEITTHSFNCGGEFFYCNTAKLFNSTYNGTYISTNSTNSTSY
ITLQCRIKQIINMWQGVGRAMYAPPIAGNITCRSNITGLLLTRDGGTNSS
EEEIFRPAGGDMRDNWRSELYKYKVVEVQPLGIAPTGAKRRVVEREKR
>CH0848.3.d1120.10.21
MRVTGILKNYPQWWIWGILGFWMLMICNGEENLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLMCSNAIVKNSTTEEMKNCSFNT
TTEIRDKEKKEYALFYRPDIVPLNNKTSNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVQIVCTRPNNNTRKSVR
IGPGQTFYATGDIIGDPRQAHCNISEKKWNETLQKVGIELQKHFPNKTIK
YNQSAGGDMEITTHSFNCGGEFFYCNTAKLFNSTYNGTYISTNSTDSTSN
ITLQCRIKQIINMWQGVGRAMYAPPIAGNITCRSNITGLLLTRDGGINND
SNETETFRPAGGDMRDNWRSELYKYKVVEVQPLGIAPTGAKRRVVEREKR

>CH0848.3.d1120.10.41
MRVMGIQKNYPRWWIWGILGFWMLMICNGEGKLWVTVYYGVPVWKEAKTT
LFCASDARAYEKEVHNVWATHACVPTDPSPQELVLGNVTENFNMWKNDMV
DQMHEDIISLWDQSLKPCVKLTPLCVTLICSNATVKNSTTEEMKNCSFNT
TTEIRDKEKKEHALFYRPDIVPLNNETGNTSEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVQLNTSVEIVCTRPNNNTRKSVR
IGPGQTFYATGDIIGDIKQAHCNISEEKWNDTLQKVGIELQKHFPNKTIK
YNQSAGGDMEITTHSFNCGGEFFYCNTSKLFNSTYNGTYISTNSTNSTSY
ITLQCRIKQIINMWQGVGRAMYAPPIAGNITCRSNITGLLLTRDGGINND
SNETETFRPAGGDMRDNWRSELYKYKVVEIQPLGIAPTGAKRRVVEREKR

>CH0848.3.d1305.10.21
MRVTGILKNYPRWWIWGILGFWMLMICNGKGKLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLICSNATVENSTTEEMKNCSFNT
TTEIRDKEKKEHALFYRPDIVPLNNETGNTSEYRLINCNTSAVTQACPKV
TFEPIPIHYCAPAGYAILKCNDETFNGTGPCSKVSTVQCTHGIRPVVSTQ
LLLNGSLAEKGIVIRSENLTNNAKIIIVQLNTSVEIVCTRPNNNTRKSVR
IGPGQTFYATGDIIGNIRQAHCNISESKWNDTLQKVGIELQKHFPNKTIK
YNQSAGGDMEITTHSFNCGGEFFYCNTAKLFNSTYNGTYISTNSTNSTSK
NITLQCRIKQIINMWQGVGRAMYAPPIAGNITCRSNITGLLLTRDGGTTN
NSNETETFRPAGGDMRDNWRSELYKYKVVEVQPLGIAPTGAKRRVVEREK
R
>CH0848.3.d1432.5.06
TRVMGIPKNYPRWWIWGILGFWMLMICNGKGKLWVTVYYGVPVWKEAKTT
LFCASDAKAYVKEVHNVWATHACVPTDPSPQELLLKNVTENFNMWKNDMV
DQMHEDIISLWDQSLKPCVKLTPLCVTLICSNATVENSTTDEMKNCSFNT
TTEIRDKEKKERALFYRPDIVPLNNETGNTSEYRLINCNTSAITQACPKV
TFEPIPIHYCAPAGYAILKCNDETFNGTGPCSSVSTVQCTHGIRPVVSTQ
LLLNGSLAEKGIVIRSENLTNNAKIIIVHLNASVEIVCTRPNNNTRKSVR
IGPGQTFYATGDIIGDIRQAHCNISEKKWNETLQKVGIELQKHFPNKTIK
YNQSAGGDMEITTHSFNCGGEFFYCNTAKLFNSTYNGTYISTNSINSTLN
```

Figure 2 continued

ITLQCRIKQIINMWQGVGRAMYAPPIAGNITCRSNITGLLLTRDGGIHND
SNETETFRPAGGDMRDNWRSELYKYKVVEVQPLGIAPTGAKRRVVEREKR

>CH0848.3.d1432.5.48
TRVMGIPKNYPRWWIWGILGFWMLMICNGKGKLWVTVYYGVPVWKEAKTT
LFCASDAKAYVKEVHNVWATHACVPTDPSPQELLLKNVTENFNMWKNDMV
DQMHEDIISLWDQSLKPCVKLTPLCVTLICSNATVENSTTDEMKNCSFNT
TTEIRDKEKKERALFYRPDIVPLNNETGNTSEYRLINCNTSAITQACPKV
TFEPIPIHYCAPAGYAILKCNDETFNGTGPCSSVSTVQCTHGIRPVVSTQ
LLLNGSLAEKGIVIRSENLTNNAKIIIVHLNASVEIVCTRPNNNTRKSVR
IGPGQTFYATGDIIGDIRQAHCNISEKKWNETLQKVGIELQKHFPNKTIK
YNQSAGGDMEITTHSFNCGGEFFYCNTAKLFNSTYNGTYISTNSINSTLN
ITLQCRIKQIINMWQGVGRAMYAPPIAGNITCRSNITGLLLTRDGGIHND
SNETETFRPAGGDMRDNWRSELYKYKVVEIQPLGIAPTGAKRRVVEREKR

>CH0848.3.d1432.5.35
TRVMGIPKNYPRWWIWGILGFWMLMICNGKGKLWVTVYYGVPVWKEAKTT
LFCASDAKAYVKEVHNIWATHACVPTDPSPQELLLKNVTENFNMWKNDMV
DQMHEDIISLWDQSLKPCVKLTPLCVTLICSNATVNQSTTEEMKNCSFNT
TTEIRDKEKKEHALFYRPDIVPLDNETGNTSEYRLINCNTSAVTQACPKV
TFEPIPIHYCAPAGYAILKCNDETFNGTGPCSKVSTVQCTHGIRPVVSTQ
LLLNGSLAEKGIVVRSENLTNNAKIIIVQLNASVEIVCTRPNNNTRKSVR
IGPGQTFYATGDIIGNIRQAHCNISEKKWNETLQKVGIELQKHFPNKTIK
YNQSAGGDMEITTHSFNCGGEFFYCNTAKLFNSTYNGTYISTNSINSTLN
ITLQCRIKQIINMWQGVGRAMYAPPIAGNITCRSNITGLLLTRDGGIHND
SNETETFRPAGGDMRDNWRSELYKYKVVEVQPLGIAPTGAKRRVVEREKR

>CH0848.3.d1720.5.01
MRVTGILKNCPLWWIWGILGFWMLMNCNGEGNLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVRNSTTEKMSDALDRN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAKEEIVIRSENLTNNAKIIIVQLNANASVE
IVCTRPNNNTRKSVRIGPGQTFYATGDIIGDIRQAHCNISEKKWNETLQQ
VGIELQKHFPNKTIKYNQSAGGDMEITTHSFNCGGEFFYCNTAKLFNSTY
NGTYISTDSINSTLNITLQCRIKQIINMWQGVGRAMYAPPIAGNITCRSN
ITGLLLTRDGGIHNDSNVTETFRPAGGDMRDNWRSELYKYKVVEIQPLGI
APTGAKRRVVGREKR
>CH0848.3.d1651.7.50
MRVMGILKNYPRWWIWGILGFWMLMICNGKGKLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVKNSTTEELSNALARN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAEKGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTTKLFNSTY
NGTYISTNSINSTLNITLQCRIKQIINMWQGIGRAMYAPPIAGNITCRSN
ITGLLLTRDGGIHNDSNETETFRPAGGDMRDNWRSELYKYKVVEIQPLGI
APTGAKRRVVERGKR
>CH0848.3.d1651.10.07
TRVMGIPKNYPLWWIWGILGFWMLMNCNGEGNLWVTVYYGVPVWKEAKTT
LFCASDAKAYVKEVHNVWATHACVPTDPSPQELVLDNVTENFNMWKNDMV

Figure 2 continued

```
DQMHEDIISLWDQSLKPCVKLTPLCVTLNCSNAIVKNSTTEEISHALARN
STTEEMKNCSFNTTTEIRDKEKKEYALFYRPDIVPLNNKTSNISEYRLIN
CNTSTVTQACPKVTFEPIPIHYCAPAGYAILKCNDETFNGTGPCSNVSTV
QCTHGIRPVVSTQLLLNGSLAEKGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSN
ITGLLLTRDGGIHNDSNVTETFRPAGGDMRDNWRSELYKYKVVEIQPLGI
APTGAKRRVVERGKR
>CH0848.3.d1621.4.46
MRVMGILKNYPRWWIWGILGFWMLMICNGKGKLWVTVYYGVPVWKEAKTT
LFCASDAKAYVKEVHNVWATHACVPTDPSPQELVLDNVTENFNMWKNDMV
DQMHEDIISLWDQSLKPCVKLTPLCVTLNCSNAIVKNSTTEELSNALARN
STTEEMKNCSFNTTTEIRDKEKKEYALFYRPDIVPLNNKTSNISEYRLIN
CNTSTVTQACPKVTFEPIPIHYCAPAGYAILKCNNETFNGTGPCSNVSTV
QCTHGIRPVVSTQLLLNGSLAKEGIVIRSENLTNNAKIIIVQLNANASVE
IVCTRPNNNTRKSVRIGPGQTFYATGDIIGNIRQAHCNISEKKWNETLQK
VGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSN
ITGLLLTRDGGIHNDSNETETFRPAGGDMRDNWRSELYKYKVVEIQPLGI
APTGAKRRVVEREKR
>CH0848.3.d1305.10.35
MRVTGIRKNCPQWWIWGILGFWMLMNCNGEGNLWVTVYYGVPVWKEAKTT
LFCASDAKAYVKEVHNVWATHACVPTDPSPQELFLKNVTENFNMWKNDMV
DQMHEDIISLWDQSLKPCVKLTPLCVTLICSTATVNNSKFEEMKNCSFNT
TTEIRDKEKKEYALFYRPDIVPLDNETSNISEYRLINCNTSAVTQACPKV
TFEPIPIHYCAPAGYAILKCNDETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGNPRQAHCNISKERWNDTLQKVGKELQKHFPNKTIK
YNQSAGGDMEITTHSFNCGGEFFYCNTSNLFNSTYNDTYISTNSTNSTSY
ITLQCRIKQIINMWQGVGRAMYAPPIAGNITCKSNITGLLLTRDGGINKD
SNETETFRPAGGDMRDNWRSELYKYKVVEVQPLGIAPTGAKRRVVEREKR

>CH0848.3.d1305.10.13
MRVTGILKNYPRWWIWGILGFWMLMICNGKGKLWVTVYYGVPVWKEAKTT
LFCASDARAYEKEVHNVWATHACVPTDPSPQELVLDNVTENFNMWKNDMV
DQMHEDIISLWDQSLKPCVKLTPLCVTLICSIATANGSTVEEMKNCSFNT
TTEIRDKEKKEYALFYRPDIVPLNNKTSNISEYRLINCNTSAVTQACPKV
TFEPIPIHYCAPAGYAILKCNNETFNGTGPCSNVSTVQCTHGIRPVVSTQ
LLLNGSLAEKEIVIRSENLTNNAKIIIVHLHTPVEIVCTRPNNNTRKSVR
IGPGQTFYATGDIIGNPRQAHCNISKERWNDTLQKVGKELQKHFPNKTIR
YNQSAGGDMEITTHSFNCGGEFFYCNTSNLFNSTYNDTYISTNSSANNSS
TITLQCRIKQIINMWQGVGRAMYAPPIAGNITCKSNITGLLLTRDGGTDS
NETETFRPAGGDMRDNWRSELYKYKVVEIQPLGIAPTGAKRRVVEREKR

>CH0848.3.d1432.5.56
MRVTGILKNYPRWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMKNCSFNTTTEIRDKEKKEYALFYRPDVVPLDETNNTSKYRLINC
NTSAVTQACPKVTFEPIPIHYCAPAGYAILKCNDETFNGTGPCSNVSTVQ
CTHGIRPVVSTQLLLNGSLAEKEIVIRSENLTNNAKIIIVHLHTPVEIVC
TRPYNNTRKSVRIGPGQTFYATGDIIGDPRQAHCNISKEIWNKTLQEVGK
ELQKHFPNKTIRYNQSAGGDMEITTHSFNCGGEFFYCNTAKLFNSTYNDT
```

Figure 2 continued

```
YKSTNSSANNSSIITLQCRIKQIINMWQGVGRAMYAPPIAGNITCKSNIT
GLLLTRDGGINNVSNETETFRPAGGDNWRSELYKYKVVEVQPLGIAPTGA
KRRVVEREKR
>CH0848.3.d1432.5.18
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMSNATVKNSTTEEMKNCSFNTTTEIRDKEKKEYALFYRPDVVPLD
ETNNTSKYRLINCNTSAVTQACPKVTFEPIPIHYCAPAGYAILKCNDETF
NGTGPCSKVSTVQCTHGIRPVVSTQLLLNGSLAEKEIVIRSENLTNNAKI
IIVHLHTPVEIVCTRPYNNTRKSVRIGPGQTFYATGDIIGDPRQAHCNIS
KEIWNKTLQEVGKELQKHFPNKTIRYNQSAGGDMEITTHSFNCGGEFFYC
NTSNLFNSTYNDTYISPNSTNSTSTITLQCRIKQIINMWQGVGRAMYAPP
IAGNITCKSNITGLLLTRDGGINNVSNETETFRPAGGDMRDNWRSELYKY
KVVEVQPLGLAPTGAKRRVVEREKR
>CH0848.3.d1432.5.26
TRVMGILKNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSNATVKN
STTEEMKNCSFNTTTEIRDKEKKEYALFYRPDVVPLDETNNTSKYRLINC
NTSAVTQACPKVTFEPIPIHYCAPAGYAILKCNDETFNGTGPCSNVSTVQ
CTHGIRPVVSTQLLLNGSLAEKEIVIRSENLTNNAKTIIVHLHTPVEIVC
TRPYNNTRKSVRIGPGQTFYATGDIIGDPRQAHCNISKETWNKTLQEVGK
ELQKHFPNKTIRYNQSAGGDMEITTHSFNCGGEFFYCNTSNLFNSTYNDT
YISPNSTNSTSTITLQCRIKQIINMWQGVGRAMYAPPIAGNITCKSNITG
LLLTRDGGTTNNSNETETFRPAGGDMRDNWRSELYKYKVVEVQPLGLAPT
GAKRRVVEREKR
>CH0848.3.d1432.5.41
MRVTGILRNYPQWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEMSTALVKN
STTEAMKNCSFNTTTEIRDKEKKEYALFYRPDIVPLNNETGNISEYRLIN
CNTSAVTQACPKVTFEPIPIHYCAPAGYAILKCNDETFNGTGPCSNVSTV
QCTHGIRPVVSTQLLLNGSLAKEEIVIRSENLTNNAKIIIVHLHTPVEIV
CTRPNNNTRKSVRIGPGQTFYATGDIIGDPRKAHCNISEKDWNKTLQEVG
KELQKHFPNKTIRYNQSAGGDMEITTHSFNCGGEFFYCNTSKLFNSTYND
TYISTNSSANNSSTITLQCRIKQIINMWQGVGRAMYAPPIAGNITCKSNI
TGLLLTRDGGPDSNETETFRPAGGDMRDNWRSELYKYKVVEVQPLGIAPT
GAKRRVVEREKR
>CH0848.3.d1651.10.04
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVENSTEAMK
NCSFNTTTEIRDKIKKERALFYRPDIVPLNNETGNISEYRLINCNTSAVT
QACPKVTFEPIPIHYCAPAGYAILKCNDETFNGTGPCSNVSTVQCTHGIR
PVVSTQLLLNGSLAEKEIVIRSENLTNNAKIIIVHLHNPVEIVCTRPYNN
TRKSVRIGPGQTFYATGDIIGDPRKAHCNISKEEWNKTLQEVGKELQKHF
PNKTIRYNQSAGGDMEITTHSFNCGGEFFYCNTSNLFNSTYNDTYISPNS
TNSTSIITLQCRIKQIINMWQGVGRAMYAPPIAGNITCKSNITGLLLTRD
GGPESNETETFRPAGGDMRDNWRSELYKYKVVEVQPLGIAPTGAKRRVVE
REKR
>CH0848.3.d1651.7.34
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
```

Figure 2 continued

```
DQMHEDIISLWDQSLKPCVKLTPLCVTLICSNAIVKNSTTEKMSNVTVNN
ITIEEMKNCSFNTTTEIRDKIKKERALFYRPDIVPLNDETNNTSKYRLIN
CNTSAVTQACPKVTFEPIPIHYCAPAGYAILKCNDETFNGTGPCSNVSTV
QCTHGIRPVVSTQLLLNGSLAEKEIVIRSENLTNNVKTIIVHLHAPVEIV
CTRPYNNTRKSVRIGPGQTFYATGDIIGDPRKAHCNISEKDWNKTLQEVG
KELQKHFPNKTIRYNQSAGGDMEITTHSFNCGGEFFYCNTSKLFNSTYND
TYISTNSTNSSANNSSIITLQCRIKQIINMWQGVGRAMYAPPIAGNITCK
SNITGLLLTRDGGPDNKTETFRPAGGDMRDNWRSELYKYKVVEVQPLGIA
PTGAKRRVVEREKR
>CH0848.3.d1621.4.31
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVENSTEAMK
NCSFNTTTEIRDKIKKERALFYRPDIVPLNDETNNTSKYRLINCNTSAVT
QACPKVTFEPIPIHYCAPAGYAILKCNDETFNGTGPCSNVSTVQCTHGIR
PVVSTQLLLNGSLAEKEIVIRSENLTNNAKIIIVHLHTPVQIVCTRPYNN
TRKSVRIGPGQTFYATGDIIGDPRKAHCNISEKDWNKTLQEVGKELQKHF
PNKTIRYNQSAGGDMEITTHSFNCGGEFFYCNTSKLFNSTYNDTYISTNS
TNSSANNSSIITLQCRIKQIINMWQGVGRAMYAPPIAGNITCKSNITGLL
LTRDGGPDNKTETFRPAGGDMRDNWRSELYKYKVVEVQPLGIAPTGAKRR
VVEREKR
>CH0848.3.d1677.5.21
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSNATVGNSTEAMK
NCSFNTTTEIRDKIKKERALFYRPDIVPLNDETNNTSKYRLINCNTSAVT
QACPKVTFEPIPIHYCAPAGYAILKCNDETFNGTGPCSNVSTVQCTHGIR
PVVSTQLLLNGSLAEKEIVIRSENLTNNVKIIIVHLHTPVQIVCTRPYNN
TRKSVRIGPGQTFYATGDIIGDPRKAHCNISEKDWNKTLQEVGKELQKHF
PNKTIRYNQSAGGDMEITTHSFNCGGEFFYCNTSKLFNSTYNDTYISTNS
TNSSANNSSIITLQCRIKQIINMWQGVGRAMYAPPIAGNITCKSNITGLL
LTRDGGPDNKTETFRPAGGDMRDNWRSELYKYKVVEVQPLGIAPTGAKRR
VVEREKR
>CH0848.3.d1621.4.44
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEKMSNVTVNN
ITIEEMKNCSFNTTTEIRDKIKKERALFYRPDIVPLNDETNNTSKYRLIN
CNTSAVTQACPKVTFEPIPIHYCAPAGYAILKCNDETFNGTGPCSNVSTV
QCTHGIRPVVSTQLLLNGSLAEKEIVIRSENLTNNAKIIIVHLHAPVEIV
CTRPYNNTRKSVRIGPGQTFYATGDIIGDPRQAHCNISKEIWNKTLQEVG
KELQKHFPNKTIRYNQSAGGDMEITTHSFNCGGEFFYCNTSNLFNSTYND
TYISPNSTNSTSIITLQCKIKQIINMWQGVGRAMYAPPIAGNITCKSNIT
GLLLTRDGGINNVSNETETFRPAGGDMRDNWRSELYKYKVVEVQPLGIAP
TGAKRRVVEREKR
>CH0848.3.d1635.10.55
MRVTGILKNCPLWWIWGILGFWMLMNCNGEGNLWVTVYYGVPVWKEAKTT
LFCASDAKAYKKEVHNVWATHACVPTDPSPQELFLKNVTENFNMWKNDMV
DQMHEDIISLWDQSLKPCVKLTPLCVTLICSNAIVKNSTTEEISNATVKN
ITIKEMKNCSFNTTTEIRDKIKKERALFYRTDIVPLNKETGNISEYRLIN
CNTSAVTQACPKVTFEPIPIHYCAPAGYAILKCNDETFNGTGPCSNVSTV
QCTHGIRPVVSTQLLLNGSLAEKEIVIRSENLTNNAKIIIVHLHNPVEIV
CTRPYNNTRKSVRIGPGQTFYATGDIIGDPRQAHCNISKEEWNKTLQEVG
KELQKHFPNKTIRYNQSAGGDMEITTHSFNCGGEFFYCNTSNLFNSTYND
```

Figure 2 continued

```
TYISPNSTNSTSIITLQCRIKQIINMWQGVGRAMYAPPIAGNITCKSNIT
GLLLTRDGGINNVSNETETFRPAGGDMRDNWRSELYKYKVVEVQPLGIAP
TGAKRRVVERGKR
```

Figure 3

```
>CH848.3.d0078.30.02.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACAAGCCGGACGTCGTGCCGCTGGACGAGACCAGCAA
CACCCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGAAGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGCACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGCCCGCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGCTGTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCCGGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGggatcc
>CH848.3.d0078.30.42.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGAACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCACGAGCAACATCACGCTCCAGTGCCGCATCAAGC
```

Figure 3 continued

```
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtgaccgaattcgggaccc
ggatcc
>CH848.3.d0107.30.12.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGAACAAGACCCTGCAGGAGGTGGGCAAGGAGCTGCAGAAGCACTTCCCCAACAAGACGAT
TAAGTACGAGCGGTCGGCCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCGGCCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtcaccgaattcgggaccc
ggatcc
>CH848.3.d0107.30.27.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
```

Figure 3 continued

```
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGAAGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtaaccgaattcgggaccc
ggatcc
>CH848.3.d0107.30.31.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGTCCAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCGCCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
```

Figure 3 continued

```
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgttaccgaattcgggaccc
ggatcc
>CH848.3.d0135.27.03.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
AGAGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtgaccgaattcgggtccc
ggatcc
>CH848.3.d0135.27.06.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGGCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCCCTGCGTGAAGCTGACCCCGCTGTGCGTGACCCTGAAGTGCAGCAACGCCATCGTGGACTCCAGC
AAGGTGTACGACACGAGGTCCAAGGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGGGATCGTCAT
CCGGTCCGAGAACCTCACGAACAACGCGAAGATCATCATCGTGCAGCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAACACCTCGTCCACGAGCAACATCACGCTCCAGTGCCGCATCAAGC
```

Figure 3 continued

```
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGGACACCAACTGGTCCAACAA
GTCGGAGAAGGACATCTGGGACAACATGACCTGGATGCAGTGGGAGCGCGAGATCTCCAACTACACCGAGACCATCTACAAGCTC
CTCGAGGACTCCCAGCACCAGCAGGAGCGGAACGAGCAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCAACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtgaccgaattcaggaccc
ggatcc
>CH848.3.d0135.60.05.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTCGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtgaccgaattcaggtccc
ggatcc
>CH848.3.d0135.60.14.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
```

Figure 3 continued

```
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACCAACTCCACGAGCAACATCACGCTCCAGTGCCGCATCAAGC
AGATCATCAACATGTGGCAGGGGGTGGGCCGCGCTATGTACGCACCGCCCATCGCCGGCCACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGTCATCCAGCGGTTCT
GCCGCGCCATCCGCAACATCCCCACCCGCATCCGCCAGGGCTTCGAGGCCTCGCTCCTGTAGTAAGgtgaccgaattcgggacct
ggatcc
>CH848.3.d0135.60.19.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACAAGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTCGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACCAACTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
```

Figure 3 continued

GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtgaccgaattcgggtcct
ggatcc
>CH848.3.d0135.60.20.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGAAGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCAACAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtcaccgaattcgggtccc
ggatcc
>CH848.3.d0135.60.32.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCACCAGCAACATCACGCTCCAGTGCCGCATCAAGC

Figure 3 continued

```
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCCGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtcaccgaattcaggaccc
ggatcc
>CH848.3.d0135.60.34.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCAACAGCAACATCACGCTCCAGTGCCGCATCAAGC
AGATCATCAACATGTGGCAGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGAGATCCAGCGGTTCT
GCCGCGCCATCCGCAACATCCCCACCCGCATCCGCCAGGGCTTCGAGGCCTCGCTCCTGTAGTAAGgtcaccgaattcaggtccc
ggatcc
>CH848.3.d0194.25.17.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGATCGAGAACTTCAACATGTGGAAGAACGACATGGTGGACCAGATGCACGAGGACATCATCTCCCT
```

Figure 3 continued

```
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGTCCGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCTCGACCAACTCGACGAGCAACATCACGCTCCAGT
GCCGCATCAAGCAGATCATCAACATGTGGCAGGGGGTGGGCCGCGCTATGTACGCACCGCCCATCGCCGGCAACATCACCTGCAA
GTCCAACATCACCGGCCTCCTGCTGACCCGCGACGGCGGCACCAAGAACAACAGCAACGAGACGGAGGAGACCTTCAGGCCAGCG
GGAGGCGACATGCGCGACAACTGGCGCTCCGAGCTGTACAAGTACAAGGTGGTGGAGATCCAGCCCCTGGGCATCGCACCCACCG
GGGCCAAGAGGCGGGTCGTGGAGCGCGAGAAGCGCGCGGCGGGCCTCGGCGCCCTGTTCCTGGGCTTCCTGGGCGCTGCGGGCTC
CACCATGGGTGCCGCGTCCATCACCCTGACCGTGCAGGCCCGCCAGCTGCTCTCCGGCATCGTGCAGCAGCAGTCCAACCTCCTG
AGGGCCATCGAGGCCCAGCAGCACATGCTGCAGCTGACCGTGTGGGGCATCAAGCAGCTGCAGGCCAGGGTGCTCGCGCTCGAGC
GCTACCTGAAGGACCAGCAGCTGCTCGGCATGTGGGGCTGCTCCGGCAAGCTGATCTGCACCACCGCGGTGCCCTGGAACGCCTC
CTGGTCCAACAAGTCGGAGAAGGACATCTGGGACAACATGACCTGGATGCAGTGGGAGCGCGAGATCTCCAACTACACCGAGACC
ATCTACATGCTCCTCGAGGACTCCCAGCACCAGCAGGAGCGGAACGAGAAGGATCTGCTCGCGCTGGACTCGTGGAACTCCCTGT
GGAACTGGTTCAACATCACCAACTGGCTGTGGTACATCCGGATCTTCATCATGATCGTGGGCGGCCTGATCGGCCTGCGCATCGT
GTTCGCCGTGCTGTCGATCGTGAACCGCGTGCGCCAGGGCTACTCCCCGCTGTCCCTGCAAACGCTGACCCCCAACCCCCGGGAG
CCGGACAGGCTGGGTGGCATCGAGGAGGAGGGCGGCGAGCAGGACCGGCGACCGCTCCATCCGCCTGGTGAACGGCTTCCTGCCCA
TCGTGTGGGACGACCTGCGCTCCCTGTGCCTGTTCTCGTACCACCGCCTGCGCGACTTCCTCCTGCTGGCGGCCCGCGTCGTGGA
GCTGCTGGGCCGGTCCTCCCTGCGGGGCCTGCAGCGCGGCTGGGAGGTGCTCAAGTACCTGGGCTCGCTGGTGCAGTACTGGGGC
CTGGAGCTGAAGAAGTCCGCCATCTCCCTGTTCGACACCATCGCCATCGCCGTGGCGGAGGGCACCGACCGCATCATCGAGGGCA
TCCAGCGGTTCTGCCGCGCCATCCGCAACATCCCCACCCGCATCCGCCAGGGCTTCGAGGCCTCGCTCCTGTAGTAAGgtcaccg
aattcgggacctggatcc
>CH848.3.d0194.25.21.optBF
gtcgacaagaaATGAAGGTGATGGGCATCCTCAAGGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGAAGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAGCACGAACTCCACCAGCTCGATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGACGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
```

Figure 3 continued

```
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtcaccgaattcgggtcct
ggatcc
>CH848.3.d0194.25.24.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTCCCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAACACGTCGTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACAACTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtaaccgaattcgggtccc
ggatcc
>CH848.3.d0194.25.48.optBF
gtcgacaagaaATGCGCGTGATGGGCATCCCGAAGAACTACCCGCAGTGGTGGATCTGGGGCATCCTGGGCTTCTGGATGCTCAT
GATCTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCATCGTGGACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTCGCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAACACGTCGTCCACGAGCAACATCACGCTCCAGTGCCGCATCAAGC
```

Figure 3 continued

```
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCCGCAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCATCTGGGGGATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACGTCCTGGTCCAACAA
GTCGGAGAAGGACATCTGGGACAACATGACCTGGATGCAGTGGGAGCGCGAGATCTCCAACTACACCGAGACCATCTACACGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCCGGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCAACATCCCCACCCGCATCCGCCAGGGCTTCGAGGCCTCGCTCCTGTAGTAAGgtaaccgaattcaggaccc
ggatcc
>CH848.3.d0274.30.02.optBF
gtcgacaagaaATGCGCGTGATGGGCATCCTCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGAACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGTGGCAGTGGAACAAGACCCTGCACGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAACACGTCGTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACTCGTCCTGGTCCAACAA
GTCGGAGAAGGACATCTGGGACAACATGACCTGGATGCAGTGGGAGCGCGAGATCTCCAACTACACCGAGACCATCTACAAGCTC
CTCGAGGACTCCCAGCACCAGCAGGAGCGGAACGAGCAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGCTGATCCAGCGGTTCT
GCCGCGCCATCCGCAACATCCCCACCCGCATCCGCCAGGGCTTCGAGGCCTCGCTCCTGTAGTAAGgtaaccgaattcaggtccc
ggatcc
>CH848.3.d0274.30.07.optBF
gtcgacaagaaATGCGCGTGATGGGCATCCCCAAGAACTACCCGCAGTGGTGGATCTGGGGCATCCTGGGCTTCTGGATACTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
```

Figure 3 continued

```
GTGGGACCAGTCCCTGAAGCCCTGCGTGAAGCTGACCCCGCTGTGCGTGACCCTGAACTGCAACAGCGCCACCGTGGACAACAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACAAGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACGACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGGCCAGTGGAACAAGACCCTGCACGAGGTGTCCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCAACACGTCGTCCACGAGCAACATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACACGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCATCGAGGGCATCCAGCGGTTCT
GCCGCGCCATCCGCCAACATCCCCACCCGCATCCGCCAGGGCTTCGAGGCCTCGCTCCTGTAGTAAGgtaaccgaattcgggacct
ggatcc
>CH848.3.d0274.30.09.optBF
gtcgacaagaaATGCGCGTGCGGGCATCCTCAAGAACTACCCGCAGTGGTGGATCTGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGATCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCACCGTGAACTCCAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACAAGCCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGCCGGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGCCAGTGGAACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCTCGACGAACTCCTCCACCAACTCGACGAGCAACATCACGCTCCAGT
GCCGCATCAAGCAGATCATCAACATGTGGCAGGGGGTGGGCCGCGCTATGTACGCACCGCCCATCGCCGGCAACATCACCTGCAA
GTCCAACATCACCGGCCTCCTGCTGACCCGCGACGGCGGCACCAAGAACAACAGCAACGAGACGGAGGAGACCTTCAGGCCAGCG
GGAGGCGACATGCGCGACAACTGGCGCTCCGAGCTGTACAAGTACAAGGTGGTGGAGATCCAGCCCCTGGGCATCGCACCCACCG
GGGCCAAGAGGCGGGTCGTGGAGCGCGAGAAGCGCGCGGCGGGCCTCGGCGCCCTGTTCCTGGGCTTCCTGGGCGCTGCGGGCTC
CACCATGGGTGCCGCGTCCATCACCCTGACCGTGCAGGCCCGCCAGCTGCTCTCCGGCATCGTGCAGCAGCAGTCCAACCTCCTG
AGGGCCATCGAGGCCCAGCAGCACATGCTGCAGCTGACCGTGTGGGGCATCAAGCAGCTGCAGGCCAGGGTGCTCGCGCTCGAGC
GCTACCTGAAGGACCAGCAGCTGCTCGGCATGTGGGGCTGCTCCGGCAAGCTGATCTGCACCACCGCGGTGCCCTGGAACGCGTC
CTGGTCCAACAAGTCGGAGAAGGACATCTGGGACAACATGACCTGGATGCAGTGGGAGCGCGAGATCTCCAACTACACCGAGACC
ATCTACATGCTCCTCGAGGACTCCCAGCGGCAGCAGGAGCGGAACGAGAAGGATCTGCTCGCGCTGGACTCGTGGAACTCCCTGT
GGAACTGGTTCAACATCACCAACTGGCTGTGGTACATCCGGATCTTCATCATGATCGTGGGCGGCCTGATCGGCCTGCGCATCGT
GTTCGCCGTGCTGTCGATCGTGAACCGCGTGCGCCAGGGCTACTCCCCGCTGTCCCTGCAAACGCTGACCCCCAACCCCCGGGAG
```

Figure 3 continued

CCGGACAGGCTGGGTGGCATCGAGGAGGAGGGCGGCGAGCAGGACCGCGACCGCTCCATCCGCCTGGTGTCCGGCTTCCTGCCCA
TCGTGTGGGACGACCTGCGCTCCCTGTGCCTGTTCTCGTACCACCGCCTGCGCGACTTCCTCCTGCTGGCGGCCCGCGTCGTGGA
GCTGCTGGGCCGGTCCTCCCTGCGGGGCCTGCAGCGCGGCTGGGAGGTGCTCAAGTACCTGGGCTCGCTGGTGCAGTACTGGGGC
CTGGAGCTGAAGAAGTCCGCCATCTCCCTGTTCGACACCATCGCCATCGCCGTGGCGGAGGGCACCGACCGCATCATCGAGGGCA
TCCAGCGGTTCTGCCGCGCCATCCGCAACATCCCCACCCGCATCCGCCAGGGCTTCGAGGCCTCGCTCCTGTAGTAAGgtaaccg
aattcgggtcctggatcc
>CH848.3.d0274.30.14.optBF
gtcgacaagaaATGCGCGTGATGGGCATCCTCAAGAACTACCTGCAGTGGTGGATCTGGGGCATCCTGGGCTTCTGGATGCTCAT
GATCTGCAAGGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGAGAACGTGATCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGACCTGCAGCAACGCCACCGTGGACAACAGC
AAGGTGTACGACACGAGGTCCAACGTGAACGTCACGAGCATCAACAACACGATCATGGGCGAGATGAAGAACTGCTCCTTCAACA
CGACGACGGAGATCCGCGACAAGGAGAAGAAGGAGTACGCCCTGTTCTACCGGTCGGACGTCGTGCCGCTGGACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACAAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCCGAGAAGGAGATCGTCAT
CCGGTCCGAGAACCTCACGAACAACGCGAAGATCATCATCGTGCACCTGAACACGTCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGCGGCAGTGGTACAAGACCCTGCAGGAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAACCTGTTCAACGGCACCTACAACGGCACCTACATCTCGATCAACTCCACGAGCTACATCACGCTCCAGTGCCGCATCAAGC
AGATCATCAACATGTGGCAGGGGTGGGCCGCGCTATGTACGCACCGCCCATCGCCGGCAACATCACCTGCAAGTCCAACATCAC
CGGCCTCCTGCTGACCCGCGACGGCGGCACCAAGAACAACAGCAACGAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACACCTCCTGGTCCAACAA
GTCGGAGAAGGACATCTGGGACAACATGACCTGGATGCAGTGGGAGCGCGAGATCTCCAACTACACCGAGACCATCTACACGCTC
CTCGAGGACTCCCAGCACCAGCAGGAGCGGAACGAGAAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCCTCGAGGTGATCCAGCGGTTCT
GCCGCGCCATCCGCAACATCCCCACCCGCATCCGCCAGGGCTTCGAGGCCTCGCTCCTGTAGTAAGgttaccgaattcgggtccc
ggatcc
>CH848.3.d0358.80.03.optBF
gtcgacaagaaATGAAGGTGATGGGCATCCTCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGGGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCAGGTCCAACGTGAAC
GTCACGAGCATCAACAACACGATCATGGGCGAGATGAAGAACTGCTCCTTCAACACGACGACGGAGATCCGCGACAAGGAGAAGA
AGGAGTACGCCCTGTTCTACAAGCCCGACGTCGTGCCGCTGAACGAGACCAGCAACACCTCGGAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACAACGAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCCGAGAAGGAGATCGTCATCGGTCCGAGAACCTCACGAACAACGCGAA
GATCATCATCGTGCACCTGAACACGCCGGTGGAGATCGTGTGCACCCGCCCGGGCAACAACACGCGCAAGTCCGTCCGGATCGGC
CCTGGCCAGACCTTCTACGCCACCGGCGACATCATCGGCGACATCCGCCAGGCCCACTGCAACATCAGCGAGGGGCAGTGGAACA
AGACCCTGCAGGAGGTGGGCAAGGAGCTGCAGAAGCACTTCCCCAACAAGACGATTAAGTACGAGCGGTCGGCCGGCGGCGACAT
GGAGATCACCACGCACTCCTTCAACTGCGGTGGCGAGTTCTTCTACTGCAACACGTCGAACCTGTTCAACGGCACCTACAACGGC
ACCTACATCAACATCTCCACCAACTCCAACAGCACGATCACGCTCCAGTGCCGCATCAAGCAGATCATCAACATGTGGCAGGGGG

Figure 3 continued

```
TGGGCCGCGCTATGTACGCACCGCCCATCGCCGGCAACATCACCTGCAAGTCCAACATCACCGGCCTCCTGCTGACCCGCGACGG
CGGCACCAAGAACAACAGCAACGAGGAGACCTTCAGGCCAGCGGGAGGCGACATGCGCGACAACTGGCGCTCCGAGCTGTACAAG
TACAAGGTGGTGGAGATCCAGCCCCTGGGCATCGCACCCACCGGGGCCAAGAGGCGGGTCGTGGAGCGCGAGAAGCGCGCGGCGG
GCCTCGGCGCCCTGTTCCTGGGCTTCCTGGGCGCTGCGGGCTCCACCATGGGTGCCGCGTCCATCACCCTGACCGTGCAGGCCCG
CCAGCTGCTCTCCGGCATCGTGCAGCAGCAGTCCAACCTCCTGAGGGCCATCGAGGCCCAGCAGCACATGCTGCAGCTGACCGTG
TGGGGCATCAAGCAGCTGCAGGCCAGGGTGCTCGCGCTCGAGCGCTACCTGAAGGACCAGCAGCTGCTCGGCATGTGGGGCTGCT
CCGGCAAGCTGATCTGCACCACCGCGGTGGCCTGGAACACCTCCTGGTCCAACAAGTCGGAGAAGGACATCTGGGACAACATGAC
CTGGATGCAGTGGGAGCGCGAGATCTCCAACTACACCGAGACCATCTACACGCTCCTCGAGGACTCCCAGCGCCAGCAGGAGCGG
AACGAGAAGGATCTGCTCGCGCTGGACTCGTGGAACTCCCTGTGGAACTGGTTCAACATCACCAACTGGCTGTGGTACATCAAGA
TCTTCATCATGATCGTGGGCGGCCTGATCGGCCTGCGCATCGTGTTCGCCGTGCTGTCGATCGTGAACCGCGTGCGCCAGGGCTA
CTCCCCGCTGTCCCTGCAAACGCTGACCCCCAACCCCCGGGAGCCGGACAGGCTGGGTGGCATCGAGGAGGAGGGCGGCGAGCAG
GACCGCGACCGCTCCATCCGCCTGGTGTCCGGCTTCCTGCCCATCGTGTGGGACGACCTGCGCTCCCTGTGCCTGTTCTCGTACC
ACCGCCTGCGCGACTTCCTCCTGCTGGCGGCCCGCGTCGTGGAGCTGCTGCGCCGGTCCTCCCTGCGGGGCCTGCAGCGCGGCTG
GGAGGTGCTCAAGTACCTGGGCTCGCTGGTGCAGTACTGGGGCCTGGAGCTGAAGAAGTCCGCCATCTCCCTGCTCGACACCATC
GCCATCGCCGTGGCGGAGGGCACCGACCGCATCATCGAAGTGATCCAGCGGTCGTGCCGCGCCATCCGCAACATCCCCACCCGCA
TCCGCCAGGGCTTCGAGGCCTCGCTCCTGTAGTAAGgttaccgaattcaggacccggatcc
>CH848.3.d0358.80.06.optBF
gtcgacaagaaaATGCGGGTGATGGGCATCCCCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCAGGTCCAACGTGAAC
GTCACGAGCATCAACAACACGATCATGGGCGAGATGAAGAACTGCTCCTTCAACACGACGACGGAGATCCGCGACAAGGAGAAGA
AGGAGTACGCCCTGTTCTACAAGCCCGACGTCGTGCCGCTGAACGAGACCAGCAACACCTCGGAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACAACAAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCCGAGAAGGAGATCGTCATCCGGTCCGAGAACCTCACGAACAACGCGAA
GATCATCATCGTGCACCTGAACACGTCGGTGGAGATCGTGTGCACCCGCCCGGGCAACAACACGCGCAAGTCCGTCCGGATCGGC
CCTGGCCAGACCTTCTACGCCACCGGCGACATCATCGGCGACATCCGCCAGGCCCACTGCAACATCAGCGAGGGGCAGTGGAACA
AGACCCTGCACGAGGTGTCCAAGGAGCTGCAGAAGCACTTCCCCAACAAGACGATTAAGTACGAGCGGTCGGCCGGCGGCGACAT
GGAGATCGCCACGCACTCCTTCAACTGCGGTGGCGAGTTCTTCTACTGCAACACGTCGAACCTGTTCAACGGCACCTACAACGGC
ACCTACATCAACACGTCCTCCACCAGCTACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGGCAC
CAAGAACAACAGCAACGAGGAGACCTTCAGGCCAGCGGGAGGCGACATGCGCGACAACTGGCGCTCCGAGCTGTACAAGTACAAG
GTGGTGGAGATCCAGCCCCTGGGCATCGCACCCACCGGGGCCAAGAGGCGGGTCGTGGAGCGCGAGAAGCGCGGGGCCTCG
GCGCCCTGTTCCTGGGCTTCCTGGGCGCTGCGGGCTCCACCATGGGTGCCGCGTCCATCACCCTGACCGTGCAGGCCCGCCAGCT
GCTCTCCGGCATCGTGCAGCAGCAGTCCAACCTCCTGAGGGCCATCGAGGCCCAGCAGCACATGCTGCAGCTGACCGTGTGGGGC
ATCAAGCAGCTGCAGGCCAGGGTGCTCGCGCTCGAGCGCTACCTGAAGGACCAGCAGCTGCTCGGCATGTGGGGCTGCTCCGGCA
AGCTGATCTGCACCACCACGGTGCCCTGGAACACCTCCTGGTCCAACAAGTCGGAGAAGGACATCTGGGACAACATGACCTGGAT
GCAGTGGGAGCGCGAGATCTCCAACTACACCGAGACCATCTACACGCTCCTCGAGGACTCCCAGCGCCAGCAGGAGCGGAACGAG
AAGGATCTGCTCGCGCTGGACTCGTGGAACTCCCTGTGGAACTGGTTCAACATCACCAACTGGCTGTGGTACATCAAGATCTTCA
TCATGATCGTGGGCGGCCTGATCGGCCTGCGCATCGTGTTCGCCGTGCTGTCGATCGTGAACCGCGTGCGCCAGGGCTACTCCCC
GCTGTCCCTGCAAACGCTGACCCCCAACCCCCGGGAGCCGGACAGGCTGGGTGGCATCGAGGAGGAGGGCGGCGAGCAGGACCGC
GACCGCTCCATCCGCCTGGTGTCCGGCTTCCTGCCCATCGTGTGGGACGACCTGCGCTCCCTGTGCCTGTTCTCGTACCACCGCC
TGCGCGACTTCCTCCTGCTGGCGGCCCGCGTCGTGGAGCTGCTGGGCCGGTCCTCCCTGCGGGGCCTGCAGCGCGGCTGGGAGGT
GCTCAAGTACCTGGGCTCGCTGGTGCAGTACTGGGGCCTGGAGCTGAAGAAGTCCGCCATCTCCCTGTTCAACACCATCGCCATC
GCCGTGGCGGAGGGCACCGACCGCATCATCAAAGTGATCCAGCGGTTCTGCCGCGCCATCCGCAACATCCCCACCCGCATCCGCC
AGGGCTTCGAGGCCTCGCTCCTGTAGTAAGgttaccgaattcaggtcccggatcc
>CH848.3.d0358.80.17.optBF
gtcgacaagaaaATGCGGGTGATGGGCATCCTCAAGAACTACCCGCAGTGGTGGATCTGGGGCATCCTGGGCTTCTGGATGCTCAT
GAACTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCAGGTCCAACGTGAAC
GTCACGAGCATCAACAACACGATCATGGGCGAGATGAAGAACTGCTCCTTCAACACGACGACGGAGATCCGCGACAAGGAGAAGA
```

Figure 3 continued

```
AGGAGTACGCCCTGTTCTACCGGCCCGACGTCGTGCCGCTGAACGAGACCAGCAACACCTCGGAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACAACGAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCCGAGAAGGAGATCGTCATCCGGTCCGAGAACCTCACGAACAACGCGAA
GATCATCATCGTGCACCTGAACACGTCGGTGGAGATCGTGTGCACCCGCCCGGGCAACAACACGCGCAAGTCCGTCCGGATCGGC
CCTGGCCAGACCTTCTACGCCACCGGCGACATCATCGGCGACATCCGCCAGGCCCACTGCAACATCAGCGAGGAGAAGTGGAACA
AGACCCTGCAGCAGGTGGGCAAGGAGCTGCAGAAGCACTTCCCCAACAAGACGATTAAGTACGAGCGGTCGGCCGGCGGCGACAT
GGAGATCACCACGCACTCCTTCAACTGCGGTGGCGAGTTCTTCTACTGCAACACGTCGAACCTGTTCAACGGCACCTACAACGGC
ACCTACATCAACATCTCCACCAACTCCAACAGCACGATCACGCTCCAGTGCCGCATCAAGCAGATCATCAACATGTGGCAGGGGG
TGGGCCGCGCTATGTACGCACCGCCCATCGCCGGCAACATCACCTGCAAGTCCAACATCACCGGCCTCCTGCTGACCCGCGACGG
CGGCACCAAGAACAACAGCAACGAGGAGACCTTCAGGCCAGCGGGAGGCGACATGCGCGACAACTGGCGCTCCGAGCTGTACAAG
TACAAGGTGGTGGAGATCCAGCCCCTGGGCATCGCACCCACCGGGGCCAAGAGGCGGGTCGTGGAGCGCGAGAAGCGCGCGGCGG
GCCTCGGCGCCCTGTTCCTGGGCTTCCTGGGCGCTGCGGGCTCCACCATGGGTGCCGCGTCCATCACCCTGACCGTGCAGGCCCG
CCAGCTGCTCTCCGGCATCGTGCAGCAGCAGTCCAACCTCCTGAGGGCCATCGAGGCCCAGCAGCACATGCTGCAGCTGACCGTG
TGGGGCATCAAGCAGCTGCAGGCCAGGGTGCTCGCGCTGAGCGCTACCTGAAGGACCAGCAGCTGCTCGGCATGTGGGGCTGCT
CCGGCAAGCTGATCTGCACCACCGCGGTGGCCTGGAACACCTCCTGGTCCAACAAGTCGGAGAAGGACATCTGGGACAACATGAC
CTGGATGCAGTGGGAGCGCGAGATCTCCAACTACACCGAGACCATCTACACGCTCCTCGAGGACTCCCAGCGCCAGCAGGAGCGG
AACGAGAAGGATCTGCTCGCGCTGGACTCGTGGAACTCCCTGTGGAACTGGTTCAACATCACCAACTGGCTGTGGTACATCAAGA
TCTTCATCATGATCGTGGGCGGCCTGATCGGCCTGCGCATCGTGTTCGCCGTGCTGTCGATCGTGAACCGCGTGCGCCAGGGCTA
CTCCCCGCTGTCCCTGCAAACGCTGACCCCCAACCCCCGGGAGCCGGACAGGCTGGGTGGCATCGAGGAGGAGGCGGCGAGCAG
GACCGCGACCGCTCCATCCGCCTGGTGTCCGGCTTCCTGCCCATCGTGTGGGACGACCTGCGCTCCCTGTGCCTGTTCTCGTACC
ACCGCCTGCGCGACTTCCTCCTGCTGGCGGCCCGCGTCGTGGAGCTGCTGGGCCGGTCCTCCCTGCGGGGCCTGCAGCGCGGCTG
GGAGGTGCTCAAGTACCTGGGCTCGCTGGTGCAGTACTGGGGCCTGGAGCTGAAGAAGTCCGCCATCTCCCTGCTCGACACCATC
GCCATCGCCGTGCGGAGGGCACCGACCGCATCATCGAAGTGATCCAGCGGTCGTGCCGCGCCATCCGCAACATCCCCACCCGCA
TCCGCCAGGGCTTCGAGGCCTCGCTCCTGTAGTAAGgttaccgaattcgggacctggatcc
>CH848.3.d0358.80.44.optBF
gtcgacaagaaATGCGGGTGATGGGCATCCTCAAGAACTACCCGCGCTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCGCAGG
AGCTCGTGCTGGGGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGCCAGGTCCAACGTGAAC
GTCACGAGCATCAACAACACGATCATGGGCGAGATGAAGAACTGCTCCTTCAACACGACGACGGAGATCCGCGACAAGGAGAAGA
AGGAGTACGCCCTGTTCTACAAGCCCGACGTCGTGCCGCTGAACGAGACCAGCAACACCTCGGAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACAACAAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCCGAGAAGGAGATCGTCATCCGGTCCGAGAACCTCACGAACAACGCGAA
GATCATCATCGTGCACCTGAACACGTCGGTGGAGATCGTGTGCACCCGCCCGGGCAACAACACGCGCAAGTCCGTCCGGATCGGC
CCTGGCCAGACCTTCTACGCCACCGGCGACATCATCGGCGACATCCGCCAGGCCCACTGCAACATCAGCGAGGAGAAGTGGAACA
AGACCCTGCAGGAGGTGGGCAAGGAGCTGCAGAAGCACTTCCCCAACAAGACGATTAAGTACGAGCGGTCGGCCGGCGGCGACAT
GGAGATCGCCACGCACTCCTTCAACTGCGGTGGCGAGTTCTTCTACTGCAACACGTCGAACCTGTTCAACGGCACCTACAACGGC
ACCGACATCTCCACCAACTCCAACAGCACGATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGGCAC
CAAGAACAACAGCAACGAGGAGACCTTCAGGCCAGCGGGAGGCGACATGCGCGACAACTGGCGCTCCGAGCTGTACAAGTACAAG
GTGGTGGAGATCCAGCCCCTGGGCATCGCACCCACCGGGGCCAAGAGGCGGGTCGTGGAGCGCGAGAAGCGCGCGGCGGGCCTCG
GCGCCCTGTTCCTGGGCTTCCTGGGCGCTGCGGGCTCCACCATGGGTGCCGCGTCCATCACCCTGACCGTGCAGGCCCGCCAGCT
GCTCTCCGGCATCGTGCAGCAGCAGTCCAACCTCCTGAGGGCCATCGAGGCCCAGCAGCACATGCTGCAGCTGACCGTGTGGGGC
ATCAAGCAGCTGCAGGCCAGGGTGCTCGCGCTCGAGCGCTACCTGAAGGACCAGCAGCTGCTCGGCATGTGGGGCTGCTCCGGCA
AGCTGATCTGCACCACCACGGTGCCCTGGAACGCCTCCTGGTCCAACAAGTCGGAGAAGGACATCTGGGACAACATGACCTGGAT
GCAGTGGGAGCGCGAGATCTCCAACTACACCGAGACCATCTACATGCTCCTCGAGGACTCCCAGCGCCAGCAGGAGCGGAACGAG
AAGGATCTGCTCGCGCTGGACTCGTGGAACTCCCTGTGGAACTGGTTCAACATCACCAACTGGCTGTGGTACATCAAGATCTTCA
TCATGATCGTGGGCGGCCTGATCGGCCTGCGCATCGTGTTCGCCGTGCTGTCGATCGTGAACCGCGTGCGCCAGGGCTACTCCCC
GCTGTCCCTGCAAACGCTGACCCCCAACCCCCGGGAGCCGGACAGGCTGGGTGGCATCGAGGAGGAGGCGGCGAGCAGGACCGC
GACCGCTCCATCCGCCTGGTGTCCGGCTTCCTGCCCATCGTGTGGGACGACCTGCGCTCCCTGTGCCTGTTCTCGTACCACCGCC
TGCGCGACTTCCTCCTGCTGGCGGCCCGCGTCGTGGAGCTGCTGGGCCGGTCCTCCCTGCGGGGCCTGCAGCGCGGCTGGGAGGT
GCTCAAGTACCTGGGCTCGCTGGTGCAGTACTGGGGCCTGGAGCTGAAGAAGTCCGCCATCTCCCTGTTCAACACCATCGCCATC
```

Figure 3 continued

```
GCCGTGGCGGAGGGCACCGACCGCATCATCGAGGGCATCCAGCGGTTCTGCCGCGCCATCCGCAACATCCCCACCCGCATCCGCC
AGGGCTTCGAGGCCTCGCTCCTGTAGTAAGgttaccgaattcgggtcctggatcc
>CH848.3.d0445.25.04.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGTCAACGTGGTGAACGTC
ACGAACATCACGAACACGATCAAGGGCGAGATGAAGAACTGCTCCTTCAACACGACGACGGAGATCCGCGACAAGGAGAAGAAGG
AGTACGCCCTGTTCTACCGGCCCGACGTCGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCCGAGAAGGGGATCGTCATCCGGTCCGAGAACCTCACGAACAACGCGAAGAT
CATCATCGTGCAGCTGAACACGTCGGTGGAGATCGTGTGCACCCGCCCGGGCAACAACACGCGCAAGTCCGTCCGGATCGGCCCT
GGCCAGACCTTCTACGCCACCGGCGACATCATCGGCGACATCCGCCAGGCCCACTGCAACATCAGCGAGGAGAAGTGGAACAAGA
CCCTGCACGAGGTGTCGAAGGAGCTGCAGAAGCACTTCCCCAACAAGACGATTAAGTACGAGCGGTCGGCCGGCGGCGACATGGA
GATCGCCACGCACTCCTTCAACTGCGGTGGCGAGTTCTTCTACTGCAACACGTCGAAGCTGTTCAACGGCACCTACAACGGCACC
TACATCTCCACCAACTCCACCAGCTACATCACGCTCCAGTGCCGCATCAAGCAGATCATCAACATGTGGCAGGGGGTGGGCCGCG
CTATGTACGCACCGCCCATCGCCGGCAACATCACCTGCAAGTCCAACATCACCGGCCTCCTGCTGACCCGCGACGGCGGCACCAA
CAACAACAGCAACGAGGAGACCTTCAGGCCAGCGGGAGGCGACATGCGCGACAACTGGCGCTCCGAGCTGTACAAGTACAAGGTG
GTGGAGATCCAGCCCCTGGGCATCGCACCCACCGGGGCCAAGAGGCGGGTCGTGGAGCGCGAGAAGCGCGGCGGGCCTCGGCG
CCCTGTTCCTGGGCTTCCTGGGCGCTGCGGGCTCCACCATGGGTGCCGCGTCCATCACCCTGACCGTGCAGGCCCGCCAGCTGCT
CTCCGGCATCGTGCAGCAGCAGTCCAACCTCCTGAGGGCCATCGAGGCCCAGCAGCACATGCTGCAGCTGACCGTGTGGGGCATC
AAGCAGCTGCAGGCCAGGGTGCTCGCGCTCGAGCGCTACCTGAAGGACCAGCAGCTGCTCGGCATGTGGGGCTGCTCCGGCAAGC
TGATCTGCACCACCGCCGTGGCGTGGAACACCTCCTGGTCCAACAAGTCGGAGAAGGACATCTGGGACAACATGACCTGGATGCA
GTGGGAGCGCGAGATCTCCAACTACACCGAGACCATCTACACCCTCCTCGAGGACTCCCAGCGCCAGCAGGAGCGGAACGAGAAG
GATCTGCTCGCGCTGGACTCGTGGAACTCCCTGTGGAACTGGTTCAACATCACCAACTGGCTGTGGTACATCAAGATCTTCATCA
TGATCGTGGGCGGCCTGATCGGCCTGCGCATCGTGTTCGCCGTGCTGTCGATCGTGAACCGCGTGCGCCAGGGCTACTCCCCGCT
GTCCCTGCAAACGCTGACCCCCAACCCCCGGGAGCCGGACAGGCTGGGTGGCATCGAGGAGGAGGGCGGCGAGCAGGACCGCGAC
CGCTCCATCCGCCTGGTGTCCGGCTTCCTGCCCATCGTGTGGGACGACCTGCGCTCCCTGTGCCTGTTCTCGTACCACCGCCTGC
GCGACTTCCTCCTGCTGGCGGCCCGCGTCGTGGAGCTGCTGGGCCGGTCCTCCCTGCGGGGCCTGCAGCGCGGCTGGGAGGTGCT
CAAGTACCTGGGCTCGCTGGTGCAGTACTGGGGCCTGGAGCTGAAGAAGTCCGCCATCTCCCTGCTCGACACCATCGCCATCGCC
GTGGCGGAGGGCACCGACCGCATCATCGAAGTGATCCAGGGCTTCTGCCGCGCCATCCGCAACATCCCCACCCGCATCCGCCAGG
GCTTCGAGGCCTCGCTCCTGTAGTAAGggacccgaattcggtgaccggatcc
>CH848.3.d0445.25.18.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCAGCAACGTCAACGTGGTGAACGTC
ACGAACATCACGAACACGATCAAGGGCGAGATGAAGAACTGCTCCTTCAACACGACGACGGAGATCCGCGACAAGGAGAAGAAGG
AGTACGCCCTGTTCTACCGGCCCGACGTCGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCCGAGAAGGAGATCGTCATCCGGTCCGAGAACCTCACGAACAACGCGAAGAT
CATCATCGTGCACCTGCACACGCCCGTGGAGATCGTGTGCACCCGCCCGGGCAACAACACGCGCAAGTCCGTCCGGATCGGCCCT
GGCCAGACCTTCTACGCCACCGGCGACATCATCGGCGACATCCGCCAGGCCCACTGCAACATCAGCGAGGAGAAGTGGAACAAGA
CCCTGCAGGAGGTGGGCAAGGAGCTGCAGAAGCACTTCCCCAACAAGACGATTAAGTACGAGCGGTCGGCCGGCGGCGACATGGA
GATCACCACGCACTCCTTCAACTGCGGTGGCGAGTTCTTCTACTGCAACACGTCGAACCTGTTCAACGGCACCTACAACGGCCCG
TACATCAACATCTCCACCAACTCCAACAGCACCATCACGCTCCAGTGCCGCATCAAGCAGATCATCAACATGTGGCAGGGGTGG
GCCGCGCTATGTACGCACCGCCCATCGCCGGCAACATCACCTGCAAGTCCAACATCACCGGCCTCCTGCTGACCCGCGACGGCGG
CACCAAGAACAACAGCAACGAGGAGACCTTCAGGCCAGCGGGAGGCGACATGCGCGACAACTGGCGCTCCGAGCTGTACAAGTAC
AAGGTGGTGGAGATCCAGCCCCTGGGCATCGCACCCACCGGGGCCAAGAGGCGGGTCGTGGAGCGCGAGAAGCGCGCGGCGGGCC
TCGGCGCCCTGTTCCTGGGCTTCCTGGGCGCTGCGGGCTCCACCATGGGTGCCGCGTCCATCACCCTGACCGTGCAGGCCCGCCA
GCTGCTCTCCGGCATCGTGCAGCAGCAGTCCAACCTCCTGAGGGCCATCGAGGCCCAGCAGCACATGCTGCAGCTGACCGTGTGG
```

Figure 3 continued

```
GGCATCAAGCAGCTGCAGGCCAGGGTGCTCGCGCTCGAGCGCTACCTGAAGGACCAGCAGCTGCTCGGCATGTGGGGCTGCTCCG
GCAAGCTGATCTGCACCACCGCCGTGGCGTGGAACACCTCCTGGTCCAACAAGTCGGAGAAGGACATCTGGGACAACATGACCTG
GATGCAGTGGGAGCGCGAGATCTCCAACTACACCGAGACCATCTACACCCTCCTCGAGGACTCCCAGCGCCAGCAGGAGCGGAAC
GAGAAGGATCTGCTCGCGCTGGACTCGTGGAACTCCCTGTGGAACTGGTTCAACATCACCAACTGGCTGTGGTACATCAAGATCT
TCATCATGATCGTGGGCGGCCTGATCGGCCTGCGCATCGTGTTCGCCGTGCTGTCGATCGTGAACCGCGTGCGCCAGGGCTACTC
CCCGCTGTCCCTGCAAACGCTGACCCCCAACCCCCGGGAGCCGGACAGGCTGGGTGGCATCGAGGAGGAGGGCGGCGAGCAGGAC
CGCGACCGCTCCATCCGCCTGGTGTCCGGCTTCCTGCCCATCGTGTGGGACGACCTGCGCTCCCTGTGCCTGTTCTCGTACCACC
GCCTGCGCGACTTCCTCCTGCTGGCGGCCCGCGTCGTGGAGCTGCTGGGCCGGTCCTCCCTGCGGGGCCTGCAGCGCGGCTGGGA
GGTGCTCAAGTACCTGGGCTCGCTGGTGCAGTACTGGGGCCTGGAGCTGAAGAAGTCCGCCATCTCCCTGTTCGACACCCTCGCC
ATCGCCGTGGCGGAGGGCACCGACCGCATCATCGAAGTGATCCAGGGCTTCTGCCGCGCCATCCGCAACATCCCCACCCGCATCC
GCCAGGGCTTCGAGGCCTCGCTCCTGTAGTAAGggacccgaattcggtcaccggatcc
>CH848.3.d0445.25.26.optBF
gtcgacaagaaATGCGGGTGATGGGCATCCTCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGGACTGCTCGAACGTGAACGTCGTGAACGTC
ACGAACATCACCAACACGATCAAGGGCGAGATGAAGAACTGCTCCTTCAACACGACGACGGAGATCCGCGACAAGGAGAAGAAGG
AGTACGCCCTGTTCTACCGGCCCGACGTCGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCCGAGAAGGAGATCGTCATCCGGTCCGAGAACCTCACGAACAACGCGAAGAT
CATCATCGTGCACCTGAACACGCCGGTGGAGATCGTGTGCACCCGCCCGGGCAACAACACGCGCAAGTCCGTCCGGATCGGCCCT
GGCCAGACCTTCTACGCCACCGGCGACATCATCGGCGACATCCGCCAGGCCCACTGCAACATCAGCGAGAAGCAGTGGAACGAGA
CCCTGCAGAAGGTGGGCAAGGAGCTGCAGAAGCACTTCCCCAACAAGACGATTAAGTACGAGCGGTCGGCCGGCGGCGACATGGA
GATCACCACGCACTCCTTCAACTGCGGTGGCGAGTTCTTCTACTGCAACACGTCGAACCTGTTCAACGGCACCTACAACGGCACC
TACATCAACATCTCCACCAACTCCAACAGCACGATCACGCTCCAGTGCCGCATCAAGCAGATCATCAACATGTGGCAGGGGGTGG
GCCGCGCTATGTACGCACCGCCCATCGCCGGCAACATCACCTGCCGGTCCAACATCACCGGCCTCCTGCTGACCCGCGACGGCGG
CACCAAGAACAACAGCAACGAGGAGACCTTCAGGCCAGCGGGAGGCGACATGCGCGACAACTGGCGCTCCGAGCTGTACAAGTAC
AAGGTGGTGGAGATCCAGCCCCTGGGCATCGCACCCACCGGGGCCAAGAGGCGGGTCGTGGAGCGCGAGAAGCGCGCGGCGGGCC
TCGGCGCCCTGTTCCTGGGCTTCCTGGGCGCTGCGGGCTCCACCATGGGTGCCGCGTCCATCACCCTGACCGTGCAGGCCCGCCA
GCTGCTCTCCGGCATCGTGCAGCAGCAGTCCAACCTCCTGAGGGCCATCGAGGCCCAGCAGCACATGCTGCAGCTGACCGTGTGG
GGCATCAAGCAGCTGCAGGCCAGGGTGCTCGCGCTCGAGCGCTACCTGAAGGACCAGCAGCTGCTCGGCATGTGGGGCTGCTCCG
GCAAGCTGATCTGCACCACCGCGGTGCCGTGGAACTCCTCCTGGTCCAACAAGTCGGAGAAGGACATCTGGGACAACATGACCTG
GATGCAGTGGGAGCGCGAGATCTCCAACTACACCGAGACCATCTACACGCTCCTCGAGGACTCCCAGCGCCAGCAGGAGCGGAAC
GAGAAGGATCTGCTCGCGCTGGACTCGTGGAACTCCCTGTGGAACTGGTTCAACATCACCAAGTGGCTGTGGTACATCAAGATCT
TCATCATGATCGTGGGCGGCCTGATCGGCCTGCGCATCGTGTTCGCCGTGCTGTCGATCGTGAACCGCGTGCGCCAGGGCTACTC
CCCGCTGTCCCTGCAAACGCTGACCCCCAACCCCCGGGAGCCGGACAGGCTGGGTGGCATCGAGGAGGAGGGCGGCGAGCAGGAC
CGCGACCGCTCCATCCGCCTGGTGTCCGGCTTCCTGCCCATCGTGTGGGACGACCTGCGCTCCCTGTGCCTGTTCTCGTACCACC
GCCTGCGCGACTTCCTCCTGCTGGCGGCCCGCGTCGTGGAGCTGCTGGGCCGGTCCTCCCTGCGGGGCCTGCAGCGCGGCTGGGA
GGTGCTCAAGTACCTGGGCTCGCTGGTGCAGTACTGGGGCCTGGAGCTGAAGAAGTCCGCCATCTCCCTGTTCGACACCCTGGCC
ATCGCCGTGGCGGAGGGCACCGACCGCATCATCGAGATCATCCAGGGCTTCTGCCGCGCCATCCGCAACATCCCCACCCGCATCC
GCCAGGGCTTCGAGGCCTCGCTCCTGTAGTAAGggacccgaattcggtaaccggatcc
>CH848.3.d0445.30.41.optBF
gtcgacaagaaATGCGGGTGATGGGCATCCTCAAGAACTACCCGCAGTGGTGGATCTGGGGCATCCTGGGCTTCTGGATGCTCAT
GATCTGCAAGGGCAAGGGCAACCTCTGGGTGACGGTGTACTACGGCGTGCCGGTGTGGAAGGAGGCCAAGACGACCCTGTTCTGC
GCGTCGGACGCCAAGGCCTACGAGAAGGAGATGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGTGTCCAACGTGAACGTC
ACGAACATCACGAACACGATCAAGGGCGAGATGAAGAACTGCTCCTTCAACACGACGACGGAGATCCGCGACAAGGAGAAGAAGG
AGTACGCCCTGTTCTACCGGCCCGACGTCGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCGGAGAAGGAGATCGTCATCCGGTCCGAGAACCTCACGAACAACGCGAAGAT
CATCATCGTGCACCTGAACACGTCGGTGGAGATCGTGTGCACCCGCCCGGGCAACAACACGCGCAAGTCCGTCCGGATCGGCCCT
```

Figure 3 continued

```
GGCCAGACCTTCTACGCCACCGGCGACATCATCGGCGACATCCGCCAGGCCCACTGCAACATCAGCGAGGAGAAGTGGAACAAGA
CCCTGCAGCAGGTGGGCAAGGAGCTGCAGAAGCACTTCCCCAACAAGACGATTAAGTACGAGCGGTCGGCCGGCGGCGACATGGA
GATCGCCACGCACTCCTTCAACTGCGGTGGCGAGTTCTTCTACTGCAACACGTCGAACCTGTTCAACGGCACCTACAACGGCACC
TACTCCACCAACTCCACCAGCACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCACCAAGAA
CAACAGCAACGAGGAGACCTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCAACACCGCGGTGGCCTGGAACACGTCCTGGTCCAACAAGTCGGAGAAGGACATCTGGGACAACATGACCTGGATGCAGTG
GGAGCGCGAGATCTCCAACTACACCGAGACCATCTACACGCTCCTCGAGGACTCCCAGCGCCAGCAGGAGCGGAACGAGAAGGAT
CTGCTCGCGCTGGACTCGTGGAACTCCCTGTGGAACTGGTTCAACATCACCAACTGGCTGTGGTACATCAAGATCTTCATCATGA
TCGTGGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGGGTGGCATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTGGCCATCGCCGTG
GCGGAGGGCACCGACCGCATCATCGAAGTGATCCAGGGCTTCTGCCGCGCCATCCGCAACATCCCCACCCGCATCCGCCAGGGCT
TCGAGGCCTCGCTCCTGTAGTAAGggacccgaattcggttaccggatcc
>CH848.3.d0445.30.42.optBF
gtcgacaagaaATGGGGTGATGGGCATCCTCAAGAACTACCCGCCGTGGTGGATCTGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCCGGGCCTACGAGAAGGAGGTGCACAACGTGTGGGCGACCCACGCCTGCGTGCCCACGGACCCCAGCCCGCAGG
AGCTCGTGCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGTGAACGTGGTGAACGTC
ACGAACATCACGAACACGATCAAGGGCGAGATGAAGAACTGCTCCTTCAACACGACGACGGAGATCCGCGACAAGGAGAAGAAGG
AGTACGCCCTGTTCTACAAGCCCGACGTCGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCGGAGAAGGAGATCGTCATCCGGTCCGAGAACCTCACGAACAACGCGAAGAT
CATCATCGTGCACCTGAACACGTCGGTGGAGATCGTGTGCACCCGCCCGGGCAACAACACGCGCAAGTCCGTCCGGATCGGCCCT
GGCCAGACCTTCTACGCCACCGGCGACATCATCGGCGACATCCGCCAGGCCCACTGCAACATCAGCGAGGAGAAGTGGAACAAGA
CCCTGCACGAGGTGTCCAAGGAGCTGCAGAAGCACTTCCCCAACAAGACGATTAAGTACGAGCGGTCGGCCGGCGGCGACATGGA
GATCGCCACGCACTCCTTCAACTGCGGTGGCGAGTTCTTCTACTGCAACACGTCGAACCTGTTCAACGGCACCTACAACGGCACC
TACATCTCGACCAACTCGTCCGCGAACTCCAACAGCACGATCACGCTCCAGTGCCGCATCAAGCAGATCATCAACATGTGGCAGG
GGGTGGGCCGCGCTATGTACGCACCGCCCATCGCCGGCAACATCACCTGCAAGTCCAACATCACCGGCCTCCTGCTGACCCGCGA
CGGCGGCACCAAGAACAACAGCAACGAGGAGACCTTCAGGCCAGCGGGAGGCGACATGCGCGACAACTGGCGCTCCGAGCTGTAC
AAGTACAAGGTGGTGGAGATCCAGCCCCTGGGCATCGCACCCACCGGGGCCAAGAGGCGGGTCGTGGAGCGCGAGAAGCGCGCGG
CGGGCCTCGGCGCCCTGTTCCTGGGCTTCCTGGGCGCTGCGGGCTCCACCATGGGTGCCGCGTCCATCACCCTGACCGTGCAGGC
CCGCCAGCTGCTCTCCGGCATCGTGCAGCAGCAGTCCAACCTCCTGAGGGCCATCGAGGCCCAGCAGCACATGCTGCAGCTGACC
GTGTGGGGCATCAAGCAGCTGCAGGCCAGGGTGCTCGCGCTCGAGCGCTACCTGAAGGACCAGCAGCTGCTCGGCATGTGGGGCT
GCTCCGGCAAGCTGATCTGCAACACCGCGGTGGCCTGGAACACGTCCTGGTCCAACAAGTCGGAGAAGGACATCTGGGACAACAT
GACCTGGATGCAGTGGGAGCGCGAGATCTCCAACTACACCGAGACCATCTACACGCTCCTCGAGGACTCCCAGCGCCAGCAGGAG
CGGAACGAGAAGGATCTGCTCGCGCTGGACTCGTGGAACTCCCTGTGGAACTGGTTCAACATCACCAACTGGCTGTGGTACATCA
AGATCTTCATCATGATCGTGGGCGGCCTGATCGGCCTGCGCATCGTGTTCGCCGTGCTGTCGATCGTGAACCGCGTGCGCCAGGG
CTACTCCCCGCTGTCCCTGCAAACGCTGACCCCCAACCCCCGGGAGCCGGACAGGCTGGGTGGCATCGAGGAGGAGGGCGGCGAG
CAGGACCGCGACCGCTCCATCCGCCTGGTGTCCGGCTTCCTGCCCATCGTGTGGGACGACCTGCGCTCCCTGTGCCTGTTCTCGT
ACCACCGCCTGCGCGACTTCCTCCTGCTGGCGGCCCGCGTCGTGGAGCTGCTGGGCCGGTCCTCCCTGCGGGGCCTGCAGCGCGG
CTGGGAGGTGCTCAAGTACCTGGGCTCGCTGGTGCAGTACTGGGGCCTGGAGCTGAAGAAGTCCGCCATCTCCCTGCTCGACACC
CTGGCCATCGCCGTGGCGGAGGGCACCGACCGCATCATCGAAGTGATCCAGGGCTTCTGCCGCGCCATCCGCAACATCCCCACCC
GCATCCGCCAGGGCTTCGAGGCCTCGCTCCTGTAGTAAGggtcccgaattcggtgaccggatcc
>CH848.3.d0526.25.02.optBF
gtcgacaagaaATGAAGGTGATGGGCATCCTCAAGAACTACCCGCAGTGGTGGATCTGGGGCATCCTGGGCTTCTGGATGCTCAT
GATCTGCAAGGGCAAGGGCAACCTCTGGGTGACGGTGTACTACGGCGTGCCGGTGTGGAAGGAGGCCAAGACGACCCTGTTCTGC
```

Figure 3 continued

```
GCGTCGGACGCCCGCGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGCCTACGACACGCGCTCCAACGTGAACGTCACGTCCATCAACAACACGATCATGGGCGAGATGAAGAACTGCTCCTTCAACA
CGACGACGGAGATCCGCGACAAGGAGAAGAAGGAGTACGCCCTGTTCTACAAGCCCGACATCGTGCCGCTGAACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACGAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCGGAGAAGGAGATCGTCAT
CCGGTCCGAGAACCTCACGAACAACGCGAAGATCATCATCGTGCACCTGAACACGTCGGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGAAGCAGTGGAACGAGACCCTGCAGAAGGTGGGCAAGGAGCTGCAGAAGCACTTCCCCAACAAGACGAT
TAAGTACGAGCGGTCGGCCGGCGGCGACATGGAGATCGCCACGCACTCCTTCAACTGCGGTGGCGAGTTCTTCTACTGCAACACG
TCGAAGCTGTTCAACGGCACCTACAACGGCACCGACATCAACATCTCCACGAACTCCAACAGCACGATCACGCTCCAGTGCCGCA
TCAAGCAGATCATCAACATGTGGCAGGGGGTGGGCCGCGCTATGTACGCACCGCCCATCGCCGGCAACATCACCTGCAAGTCCAA
CATCACCGGCCTCCTGCTGACCCGCGACGGCGGCACCAACTCCAACAAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACGACCAACGTGCCCTGGAACACGTCCTGGTCCAACAA
GTCGGAGAAGGACATCTGGGACAACATGACCTGGATGCAGTGGGAGCGCGAGATCTCCAACTACACCGAGACCATCTACATGCTC
CTCGAGGACTCCCAGCGCCAGCAGGAGCGGAACGAGAAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGTGGCATCGAGGAGGAGGGCGGCGAGCAGGACCGCAACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCCTGGAAGTGATCCAGCGGTTCT
GCCGCGCCATCCGCAACATCCCCACCCGCATCCGCCAGGGCTTCGAGGCCTCGCTCCTGTAGTAAGaggacccgaattcggtgac
cggatcc
>CH848.3.d0526.25.09.optBF
gtcgacaagaaATGCGGGTGATGGGCATCCTCAAGAACTACCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCCGCGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGTCAACGTGACCGGGTCC
AACGTGAACGTCACGAACATCACGAACACGATCACCGGCGAGATGAAGAACTGCTCCTTCAACACGACGACGGAGATCCGCGACA
AGGAGAAGAAGGAGTACGCCCTGTTCTACAAGCCCGACGTGGTGCCGCTGAACGAGACCAGCAACACCTCGGAGTACAGGCTGAT
CAACTGCAACACCTCCGCGGTCACGCAGGCGTGCCCCAAGGTCACGTTCGAGCCCATCCCCATCCACTACTGCGCCCCCGCCGGC
TACGCCATCCTGAAGTGCAACAACGAGACCTTCAACGGGACCGGCCCGTGCAGCAACGTGTCCACCGTGCAGTGCACGCACGGCA
TCCGGCCCGTGGTGTCCACGCAGCTGCTCCTGAACGGGTCGCTGGCGGAGAAGGGGATCGTCATCCGGTCCGAGAACCTCACGAA
CAACGCGAAGATCATCATCGTGCAGCTGAACACGTCGGTGGAGATCGTGTGCACCCGCCCGGGCAACAACACGCGCAAGTCCGTC
CGGATCGGCCCTGGCCAGACCTTCTACGCCACCGGCGGCATCATCGGCGACATCCGCCAGGCCCACTGCAACATCAGCGAGTCGA
AGTGGAACGAGACCCTGCACGAGGTGTCCAAGGAGCTGCAGAAGCACTTCCCCAACAAGACGATTAAGTACGAGCGGTCGGCCGG
CGGCGACATGGAGATCACCACGCACTCCTTCAACTGCGGTGGCGAGTTCTTCTACTGCAACACGTCGAACCTGTTCAACGGCACC
TACAACGGCACCTACAACGGGACGAACTCCAACAGCACGATCACGCTCCAGTGCCGCATCAAGCAGATCATCAACATGTGGCAGG
GGGTGGGCCGCGCTATGTACGCACCGCCCATCGCCGGCAACATCACCTGCCGGTCCAACATCACCGGCCTCCTGCTGACCCGCGA
CGGCGGCACCAACTCCAACAAGACGGAGGAGACCTTCAGGCCAGCGGGAGGCGACATGCGCGACAACTGGCGCTCCGAGCTGTAC
AAGTACAAGGTGGTGGAGATCCAGCCCCTGGGCATCGCACCCACCGGGGCCAAGAGGCGGGTCGTGGAGCGCGAGAAGCGCGCGG
CGGGCCTCGGCGCCCTGTTCCTGGGCTTCCTGGGCGCTGCGGGCTCCACCATGGGTGCCGCGTCCATCACCCTGACCGTGCAGGC
CCGCCAGCTGCTCTCCGGCATCGTGCAGCAGCAGTCCAACCTCCTGAGGGCCATCGAGGCCCAGCAGCACATGCTGCAGCTGACC
GTGTGGGGCATCAAGCAGCTGCAGGCCAGGGTGCTCGCGCTCGAGCGCTACCTGAAGGACCAGCAGCTGCTCGGCATGTGGGGCT
GCTCCGGCAAGCTGATCTGCACGACCAACGTGCCCTGGAACACGTCCTGGTCCAACAAGTCGGAGAAGGACATCTGGGACAACAT
GACCTGGATGCAGTGGGAGCGCGAGATCTCCAACTACACCGAGACCATCTACACGCTCCTCGAGGACTCCCAGCGCCAGCAGGAG
CGGAACGAGAAGGATCTGCTCGCGCTGGACTCGTGGAACTCCCTGTGGAACTGGTTCAACATCACCAACTGGCTGTGGTACATCA
```

Figure 3 continued

```
AGATCTTCATCATGATCGTGGGCGGCCTGATCGGCCTGCGCATCGTGTTCGCCGTGCTGTCGATCGTGAACCGCGTGCGCCAGGG
CTACTCCCCGCTGTCCCTGCAAACGCTGACCCCCAACCCCGGGAGCCGGACAGGCTGGGTGGCATCGAGGAGGAGGGCGGCGAG
CAGGACCGCGACCGCTCCATCCGCCTGGTGTCCGGCTTCCTGCCCATCGTGTGGGACGACCTGCGCTCCCTGTGCCTGTTCTCGT
ACCACCGCCTGCGCGACTTCCTCCTGCTGGCGGCCCGCGTCGTGGAGCTGCTGGGCCGGTCCTCCCTGCGGGGCCTGCAGCGCGG
CTGGGAGGTGCTCAAGTACCTGGGCTCGCTGGTGCAGTACTGGGGCCTGGAGCTGAAGAAGTCCGCCATCTCCCTGTTCGACACC
ATCGCCATCGCCGTGGCGGAGGGCACCGACCGCATCCTGGAAGTGATCCAGCGGTTCTGCCGCGCCATCCGCAACATCCCCACCC
GCATCCGCCAGGGCTTCGAGGCCTCGCTCCTGTAGTAAGaggtcccgaattcggtgaccggatcc
>CH848.3.d0526.25.10.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGGCAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGTCAACGTGGTGAACGTC
ACGAACATCACGAACACGATCAAGGGCGAGATGAAGAACTGCTCCTTCAACACGACGACGGAGATCCGCGACAAGGAGAAGAAGG
AGTACGCCCTGTTCTACCGCCCCGACGTGGTGCCGCTGAACGAGACCAGCAACACCTCGGAGTACAGGCTGATCAACTGCAACAC
CTCCGCGGTCACGCAGGCGTGCCCCAAGGTCACGTTCGAGCCCATCCCCATCCACTACTGCGCCCCCGCCGGCTACGCCATCCTG
AAGTGCAACAACGAGACCTTCAACGGGACCGGCCCGTGCAGCAACGTGTCCACCGTGCAGTGCACGCACGGCATCCGGCCCGTGG
TGTCCACGCAGCTGCTCCTGAACGGGTCGCTGGCGGAGAAGGAGATCGTCATCCGGTCCGAGAACCTCACGAACAACGCGAAGAT
CATCATCGTGCACCTGCACACGCCCGTGGAGATCGTGTGCACCCGCCCGGGCAACAACACGCGCAAGTCCGTCCGGATCGGCCCT
GGCCAGACCTTCTACGCCACCGGCGACATCATCGGCGACATCCGCCAGGCCCACTGCAACATCAGCGAGGAGAAGTGGAACAAGA
CCCTGCAGCAGGTGGGCAAGGAGCTGCAGAAGCACTTCCCCAACAAGACGATTAAGTACGAGCGGTCGGCCGGCGGCGACATGGA
GATCACCACGCACTCCTTCAACTGCGGTGGCGAGTTCTTCTACTGCAACACGTCGAACCTGTTCAACGGCACCTACAACGGCAAG
TACATCAACATCTCCACGAACTCCAACAGCACGATCACGCTCCAGTGCCGCATCAAGCAGATCATCAACATGTGGCAGGGGGTGG
GCCGCGCTATGTACGCACCGCCCATCGCCGGCAACATCACCTGCAAGTCCAACATCACCGGCCTCCTGCTGACCCGCGACGGCGG
CACCAAGAACAACTCGACGGAGACGGAGGAGACCTTCAGGCCAGCGGGAGGCGACATGCGCGACAACTGGCGCTCCGAGCTGTAC
AAGTACAAGGTGGTGGAGATCCAGCCCCTGGGCATCGCACCCACCGGGGCCAAGAGGCGGGTCGTGGAGCGCGAGAAGCGCGCGG
CGGGCCTCGGCGCCCTGTTCCTGGGCTTCCTGGGCGCTGCGGGCTCCACCATGGGTGCCGCGTCCATCACCCTGACCGTGCAGGC
CCGCCAGCTGCTCTCCGGCATCGTGCAGCAGCAGTCCAACCTCCTGAGGGCCATCGAGGCCCAGCAGCACATGCTGCAGCTGACC
GTGTGGGGCATCAAGCAGCTGCAGGCCAGGGTGCTCGCGCTCGAGCGCTACCTGAAGGACCAGCAGCTGCTCGGCATGTGGGGCT
GCTCCGGCAAGCTGATCTGCGACCGACGTGCCCTGGAACACGTCCTGGTCCAACAAGTCGGAGAAGGACATCTGGGACAACAT
GACCTGGATGCAGTGGGAGCGCGAGATCTCCAACTACACCGAGACCATCTACACGCTCCTCGAGGACTCCCAGCGCCAGCAGGAG
CGGAACGAGAAGGATCTGCTCGCGCTGGACTCGTGGAACTCCCTGTGGAACTGGTTCAACATCACCAACTGGCTGTGGTACATCA
AGATCTTCATCATGATCGTGGGCGGCCTGATCGGCCTGCGCATCGTGTTCGCCGTGCTGTCGATCGTGAACCGCGTGCGCCAGGG
CTACTCCCCGCTGTCCCTGCAAACGCTGACCCCCAACCCCGGGAGCCGGACAGGCTGCGCGGCATCGAGGAGGAGGGCGGCGAG
CAGGACCGCGACCGCTCCATCCGCCTGGTGTCCGGCTTCCTGCCCATCGTGTGGGACGACCTGCGCTCCCTGTGCCTGTTCTCGT
ACCACCGCCTGCGCGACTTCCTCCTGCTGGCGGCCCGCGTCGTGGAGCTGCTGGGCCGGTCCTCCCTGCGGGGCCTGCAGCGCGG
CTGGGAGGTGCTCAAGTACCTGGGCTCGCTGGTGCAGTACTGGGGCCTGGAGCTGAAGAAGTCCGCCATCTCCCTGTTCGACACC
ATCGCCATCGCCGTGGCGGAGGGCACCGACCGCATCCTGGAAGTGATCCAGCGGTTCTGCCGCGCCATCCGCAACATCCCCACCC
GCATCCGCCAGGGCTTCGAGGCCTCGCTCCTGTAGTAAGggacctgaattcggtgaccggatcc
>CH848.3.d0526.25.11.optBF
gtcgacaagaaATGCGGGTGATGGGCATCCTCAAGAACTGCCCGCAGTGGTGGATCTGGGGCATCCTGGGCTTCTGGATGCTCAT
GATCTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGACACGCGCTCGAACGTGTCCGTCACGTCCATCAACAACACGATCATGGGCGAGATGAAGAACTGCTCCTTCAACA
CGACGACGGAGATCCGCGACAAGGAGAAGAAGGAGTACGCCCTGTTCTACCGCCCCGACATCGTGCCGCTGAACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACGAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCGGAGAAGGAGATCGTCAT
CCGGTCCGAGAACCTCACGAACAACGCGAAGATCATCATCGTGCACCTGAACACGCCCGTGGAGATCGTGTGCACCCGCCCGTCC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGAGAAGTGGAACAAGACCCTGCAGAAGGTGGGCAAGGAGCTGCAGAAGCACTTCCCCAACAAGACGAT
TAAGTACGAGCGGTCGGCCGGCGGCGACATGGAGATCACCACGCACTCCTTCAACTGCGGTGGCGAGTTCTTCTACTGCAACACG
TCGAACCTGTTCAACGGCACCTACAACGGCACGTACACCAACATCTCCACGAACTCCAACAGCACGATCACGCTCCAGTGCCGCA
```

Figure 3 continued

```
TCAAGCAGATCATCAACATGTGGCAGGGGGTGGGCCGCGCTATGTACGCACCGCCCATCGCCGGCAACATCACCTGCCGGTCCAA
CATCACCGGCCTCCTGCTGACCCGCGACGGCGGCACCAACTCGAACAAGACGGAGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACGACCAACGTGCCCTGGAACACGTCCTGGTCCAACAA
GTCGGAGAAGGACATCTGGGACAACATGACCTGGATGCAGTGGGAGCGCGAGATCTCCAACTACACCGAGACCATCTACACGCTC
CTCGAGGACTCCCAGCGCCAGCAGGAGCGGAACGAGAAGGATCTGCTCGCGCTGGACTCGTGGAACTCCCTGTGGAACTGGTTCA
ACATCACCAACTGGCTGTGGTACATCAAGATCTTCATCATGATCGTGGGCGGCCTGATCTGCCTGCGCATCGTGTTCGCCGTGCT
GTCGATCGTGAACCGCGTGCGCCAGGGCTACTCCCCGCTGTCCCTGCAAACGCTGACCCCCAACCCCCGGGAGCCGGACAGGCTG
GGCGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCCTCGCCATCGCCGTGGCGGAGGGCACCGACCGCATCATCGAAGTGATCCAGGGGTTCT
GCCGCGCCATCCGCAACATCCCCACCCGCATCCGCCAGGGCTTCGAGGCCTCGCTCCTGTAGTAAGggtcctgaattcggtgacc
ggatcc
>CH848.3.d0526.25.21.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTGCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCGTGAACGTCACGAACATCACGAAC
ACGATCAAGGGCGAGATGAAGAACTGCTCCTTCAACACGACGACGGAGATCCGCGACAAGGAGAAGAAGGAGTACGCCCTGTTCT
ACCGCCCCGACGTCGTGCCGCTGAACGAGACCAGCAACACCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACAACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGGGATCGTCATCCGGTCCGAGAACCTCACGAACAACGCGAAGATCATCATCGTGCAGCT
GAACACGTCGGTGGAGATCGTGTGCACCCGCCCGGGGAACAACACGCGCAAGTCCGTCCGGATCGGCCCTGGCCAGACCTTCTAC
GCCACCGGCGACATCATCGGCGACATCCGCCAGGCCCACTGCAACATCAGCGAGGAGAAGTGGAACAAGACCCTGCAGCAGGTGG
GCAAGGAGCTGCAGAAGCACTTCCCCAACAAGACGATTAAGTACGAGCGGTCGGCCGGCGGCGACATGGAGATCACCACGCACTC
CTTCAACTGCGGTGGCGAGTTCTTCTACTGCAACACGTCGAACCTGTTCAACGGCACCTACAACGGCACGTACAACGGCTCCACG
AACTCCAACAGCACGATCACGCTCCAGTGCCGCATCAAGCAGATCATCAACATGTGGCAGGGGGTGGGCCGCGCTATGTACGCAC
CGCCCATCGCCGGCAACATCACCTGCCGGTCCAACATCACCGGCCTCCTGCTGACCCGCGACGGCGGCACCAACTCGAACAAGAC
GGAGGAGACCTTCAGGCCAGCGGGAGGCGACATGCGCGACAACTGGCGCTCCGAGCTGTACAAGTACAAGGTGGTGGAGATCCAG
CCCCTGGGCATCGCACCCACCGGGGCCAAGAGGCGGGTCGTGGAGCGCGAGAAGCGCGCGGCGGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCACGA
CCAACGTGCCCTGGAACACGTCCTGGTCCAACAAGTCGGAGAAGGACATCTGGGACAACATGACCTGGATGCAGTGGGAGCGCGA
GATCTCCAACTACACCGAGACCATCTACACGCTCCTCGAGGACTCCCAGCGCCAGCAGGAGCGGAACGAGAAGGATCTGCTCGCG
CTGGACTCGTGGAACTCCCTGTGGAACTGGTTCAACATCACCAACTGGCTGTGGTACATCAAGATCTTCATCATGATCGTGGGCG
GCCTGATCGGCCTGCGCATCGTGTTCGCCGTGCTGTCGATCGTGAACCGCGTGCGCCAGGGCTACTCCCCGCTGTCCCTGCAAAC
GCTGACCCCCAACCCCCGGGAGCCGGACAGGCTGGGCGGCATCGAGGAGGAGGGCGGCGAGCAGGACCGCGACCGCTCCATCCGC
CTGGTGTCCGGCTTCCTGCCCATCGTGTGGGACGACCTGCGCTCCCTGTGCCTGTTCTCGTACCACCGCCTGCGCGACTTCCTCC
TGCTGGCGGCCCGCGTCGTGGAGCTGCTGGGCCGGTCCTCCCTGCGGGGCCTGCAGCGCGGCTGGGAGGTGCTCAAGTACCTGGG
CTCGCTGGTGCAGTACTGGGGCCTGGAGCTGAAGAAGTCCGCCATCTCCCTGTTCGACACCATCGCCATCGCCGTGGCGGAGGGC
ACCGACCGCATCCTCGAAGTGATCCAGCGCTTCTGCCGCGCCATCCGCAACATCCCCACCCGCATCCGCCAGGGCTTCGAGGCCT
CGCTCCTGTAGTAAGggtcccgaattcggtcaccggatcc
>CH848.3.d0526.25.32.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCCGCGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
```

Figure 3 continued
```
ACCGTCTACGACACGCGCTCCAACGCGAACGTCACGTCCATCAACAACACGATCATGGGCGAGATGAAGAACTGCTCCTTCAACA
CGACGACGGAGATCCGCGACAAGGAGAAGAAGGAGTACGCCCTGTTCTACCGGCCCGACATCGTGCCGCTGAACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACGAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCGGAGAAGGAGATCGTCAT
CCGGTCCGAGAACCTCACGAACAACGCGAAGATCATCATCGTGCACCTGCACACGCCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGAGAAGTGGAACAAGACCCTGCAGAAGGTGGGCAAGGAGCTGCAGAAGCACTTCCCCAACAAGACGAT
TAAGTACGAGCGGTCGGCCGGCGGCGACATGGAGATCACCACGCACTCCTTCAACTGCGGTGGCGAGTTCTTCTACTGCAACACG
TCGAACCTGTTCAACGGCACCTACAACGGCACCTACAACGGGACCAACTCGAACAGCACGATCACGCTCCAGTGCCGCATCAAGC
AGATCATCAACATGTGGCAGGGGGTGGGCCGCGCTATGTACGCACCGCCCATCGCCGGCAACATCACCTGCCGGTCCAACATCAC
CGGCCTCCTGCTGACCCGCGACGGCGGCACCAACTCCAACAAGACGGAGGAGACCTTCAGGCCAGCGGGAGGCGACATGCGCGAC
AACTGGCGCTCCGAGCTGTACAAGTACAAGGTGGTGGAGATCCAGCCCCTGGGCATCGCACCCACCGGGGCCAAGAGGCGGGTCG
TGGAGCGCGAGAAGCGCGCGGCGGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCCCAG
CAGCACATGCTGCAGCTGACCGTGTGGGGCATCAAGCAGCTGCAGGCCAGGGTGCTCGCGCTCGAGCGCTACCTGAAGGACCAGC
AGCTGCTCGGCATGTGGGGCTGCTCCGGCAAGCTGATCTGCACGACCACGGTGGCGTGGAACACGTCCTGGTCCAACAAGTCGGA
GAAGGACATCTGGGACAACATGACCTGGATGCAGTGGGAGCGCGAGATCTCCAACTACACCGAGACCATCTACACCCTCCTCGAG
GACTCCCAGCGCCAGCAGGAGCGGAACGAGAAGGATCTGCTCGCGCTGGACTCGTGGAACTCCCTGTGGAACTGGTTCAACATCA
CCAACTGGCTGTGGTACATCAAGATCTTCATCATGATCGTGGGCGGCCTGATCGGCCTGCGCATCGTGTTCGCCGTGCTGTCGAT
CGTGAACCGCGTGCGCCAGGGCTACTCCCCGCTGTCCCTGCAAACGCTGACCCCCAACCCCCGGGAGCCGGACAGGCTGGGTGGC
ATCGAGGAGGAGGGCGGCGAGCAGGACCGCGACCGCTCCATCCGCCTGGTGTCCGGCTTCCTGCCCATCGTGTGGGACGACCTGC
GCTCCCTGTGCCTGTTCTCGTACCACCGCCTGCGCGACTTCCTCCTGCTGGCGGCCCGCGTCGTGGAGCTGCTGGGCCGGTCCTC
CCTGCGGGGCCTGCAGCGCGGCTGGGAGGTGCTCAAGTACCTGGGCTCGCTGGTGCAGTACTGGGGCCTGGAGCTGAAGAAGTCC
GCCATCTCCCTGTTCGACACCATCGCCATCGCCGTGGCGGAGGGCACCGACCGCATCCTGGAAGTGATCCAGGGGTTCTGCCGCG
CCATCCGCAACATCCCCACCCGCATCCGCCAGGGCTTCGAGGCCTCGCTCCTGTAGTAAgaggacccgaattcggtcaccggatc
c
>CH848.3.d0526.25.39.optBF
gtcgacaagaaATGCGGGTGATGGGCATCCCCAAGAACTACCCGCAGTGGTGGATCTGGGGCATCCTGGGCTTCTGGATGCTCAT
GATCTGCTCGGCCGCGGGAACCTCTGGGTGACGGTGTACTACGGCGTGCCGGTGTGGAAGGAGGCCAAGACGACCCTGTTCTGC
GCGTCGGACGCCAAGGCCTACGAGAAGGAGATGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGACACGCGCTCCAACGTGAACGTCACGTCCATCAACAACACGATCATGGGCGAGATGAAGAACTGCTCCTTCAACA
CGACGACGGAGATCCGCGACAAGGAGAAGAAGGAGTACGCCCTGTTCTACAAGCCCGACATCGTGCCGCTGAACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACAACGAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCGGAGAAGGAGATCGTCAT
CCGGTCCGAGAACCTCACGAACAACGCGAAGATCATCATCGTGCACCTGAACACGCCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGAGAAGTGGAACAAGACCCTGCAGAAGGTGGGCAAGGAGCTGCAGAAGCACTTCCCCAACAAGACGAT
TAAGTACGAGCGGTCGGCCGGCGGCGACATGGAGATCACCACGCACTCCTTCAACTGCGGTGGCGAGTTCTTCTACTGCAACACG
TCGAAGCTGTTCAACGGCACCTACAACGGGATCAACATCTCGACCAACTCGAACAGCACGATCACGCTCCAGTGCCGCATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCAACCGGAACAACAGCAACGAGGAGACCTTCAGGCCAGCGGGAGGCGACATGCGCGAC
AACTGGCGCTCCGAGCTGTACAAGTACAAGGTGGTGGAGATCCAGCCCCTGGGCATCGCACCCACCGGGGCCAAGAGGCGGGTCG
TGGAGCGCGAGAAGCGCGCGGCGGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCCCAG
CAGCACATGCTGCAGCTGACCGTGTGGGGCATCAAGCAGCTGCAGGCCAGGGTGCTCGCGCTCGAGCGCTACCTGAAGGACCAGC
AGCTGCTCGGCATGTGGGGCTGCTCCGGCAAGCTGATCTGCACGACCAACGTGCCCTGGAACACGTCCTGGTCCAACAAGTCGGA
GAAGGACATCTGGGACAACATGACCTGGATGCAGTGGGAGCGCGAGATCTCCAACTACACCGAGACCATCTACATGCTCCTCGAG
GACTCCCAGCGCCAGCAGGAGCGGAACGAGAAGGATCTGCTCGCGCTGGACTCGTGGAACTCCCTGTGGAACTGGTTCAACATCA
CCAACTGGCTGTGGTACATCAAGATCTTCATCATGATCGTGGGCGGCCTGATCGGCCTGCGCATCGTGTTCGCCGTGCTGTCGAT
CGTGAACCGCGTGCGCCAGGGCTACTCCCCGCTGTCCCTGCAAACGCTGACCCCCAACCCCCGGGAGCCGGACAGGCTGGGTGGC
ATCGAGGAGGAGGGCGGCGAGCAGGACCGCGACCGCTCCATCCGCCTGGTGTCCGGCTTCCTGCCCATCGTGTGGGACGACCTGC
```

Figure 3 continued

```
GCTCCCTGTGCCTGTTCTCGTACCACCGCCTGCGCGACTTCCTCCTGCTGGCGGCCCGCGTCGTGGAGCTGCTGGGCCGGTCCTC
CCTGCGGGGCCTGCAGCGCGGCTGGGAGGTGCTCAAGTACCTGGGCTCGCTGGTGCAGTACTGGGGCCTGGAGCTGAAGAAGTCC
GCCATCTCCCTGTTCGACACCATCGCCATCGCCGTGGCGGAGGGCACCGACCGCATCCTGGAAGTGATCCAGCGGTTCTGCCGCG
CCATCCGCAACATCCCCACCCGCATCCGCCAGGGCTTCGAGGCCTCGCTCCTGTAGTAAGaggtcccgaattcggtcaccggatc
c
>CH848.3.d0611.9.02.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGAGATGAAGAACTGCTCCTTCAACACGACGGAGATCCGCGACAAGGAGAAGAAGGAGTACGCCCTGTTCTACC
GGCCCGACATCGTGCCGCTGGGCGAGACCAGCAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGGGATCGTCATCCGGTCCGAGAACCTCACGAACAACGCGAAGATCATCATCGTGCACCTGCA
CACGCCCGTGGAGATCGTGTGCACCCGCCCGGGCAACAACACGCGCAAGTCCGTCCGGATCGGCCCTGGCCAGACCTTCTACGCC
ACCGGCGACATCATCGGCGACATCCGCCAGGCCCACTGCAACATCAGCGAGGAGAAGTGGAACGAGACCCTGCAGAAGGTGGGCA
AGGAGCTGCAGAAGCACTTCCCCAACAAGACGATTAAGTACGCCCAGTCGGCCGGCGGCGACATGGAGATCACCACGCACTCCTT
CAACTGCGGTGGCGAGTTCTTCTACTGCAACACGTCGAAGCTGTTCAACGGGACGTACAACGGCGCCTACATCAACATCTCGACC
AACTCGAACAGCACGATCACGCTCCAGTGCCGCATCAAGCAGATCATCAACATGTGGCAGGGGGTGGGCCGCGCTATGTACGCAC
CGCCCATCGCCGGCAACATCACCTGCAAGTCCAACATCACCGGCCTCCTGCTGACCCGCGACGGCGGCACGAACAACAAGACGGA
GGAGATCTTCAGGCCAGCGGGAGGCGACATGCGCGACAACTGGCGCTCCGAGCTGTACAAGTACAAGGTGGTGGAGATCCAGCCC
CTGGGCATCGCACCCACCGGGGCCAAGAGGCGGGTCGTGGAGCGCGAGAAGCGCGCGGCGGGCCTCGGCGCCCTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGCACGACCG
TCGTGCCCTGGAACACGTCCTGGTCCAACAAGTCGGAGAAGGACATCTGGGACAACATGACCTGGATGCAGTGGGAGCGCGAGAT
CTCCAACTACACCGAGACCATCTACAAGCTCCTCGAGGACTCCCAGAACCAGCAGGAGCGGAACGAGCAGGATCTGCTCGCGCTG
GACTCGTGGAACTCCCTGTGGAACTGGTTCAACATCACCAAGTGGCTGTGGTACATCAAGATCTTCATCATGATCGTGGGCGGCC
TGATCGGCCTGCGCATCGTGTTCGCCGTGCTGTCGATCGTGAACCGCGTGCGCCAGGGCTACTCCCCGCTGTCCCTGCAAACGCT
GACCCCCAACCCCCGGGAGCCGGACAGGCTGGGTGGCATCGAGGAGGAGGGCGGCGAGCAGGACCGCGACCGCTCCATCCGCCTG
GTGTCCGGCTTCCTGCCCATCGTGTGGGACGACCTGCGCTCCCTGTGCCTGTTCTCGTACCACCGCCTGCGCGACTTCCTCCTGC
TGGCGGCCCGCGTCGTGGAGCTGCTGGGCCGGTCCTCCCTGCGGGGCCTGCAGGAGGTGCTCAAGTACCTGGGCTC
GCTGGTGCAGTACTGGGGCCTGGAGCTGAAGAAGTCCGCCATCTCCCTGTTCGACACCCTGGCCATCGCCGTGGCGGAGGGCACC
GACCGCATCATCGAAGTGATCCAGGGCTTCTGCCGCGCCATCCGCAACATCCCCACCCGCATCCGCCAGGGCTTCGAGGCCTCGC
TCCTGTAGTAAGgaacctgaattcggtcaccggatcc
>CH848.3.d0611.20.12.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGGGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCATGGGCGAGATGAAGAACTGCTCCTTCAACACGACGACGGAGATCCGCGACAAGGAGAAGAAGGAGTACGCCCTGTTCTACA
AGCCCGACGTCGTGCCGCTGGACGAGACCAACAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTGATCCGGTCCGAGAACCTCACGAACAACGCGAAGATCATCATCGTGCACCTGAA
CACGCCCGTGGAGATCGTGTGCACCCGCCCGGGCAACAACACGCGCAAGTCCGTCCGGATCGGCCCTGGCCAGACCTTCTACGCC
ACCGGCGCGATCATCGGCGACATCCGCCAGGCCCACTGCAACATCAGCGAGTCCAAGTGGAACGAGACCCTGCAGAAGGTGGGCA
AGGAGCTGCAGAAGCACTTCCCCAACAAGACGATTAAGTACGAGCAGTCGGCCGGCGGCGACATGGAGATCACCACGCACTCCTT
CAACTGCGGTGGCGAGTTCTTCTACTGCAACACGTCGAAGCTGTTCAACGGGACGTACAACGGCGCCTACATCAACATCTCGACC
AACTCGAACAGCACGATCACGCTCCAGTGCCGCATCAAGCAGATCATCAACATGTGGCAGGGGGTGGGCCGCGCTATGTACGCAC
CGCCCATCGCCGGCAACATCACCTGCAAGTCCAACATCACCGGCCTCCTGCTGACCCGCGACGGCGGCACGAACAACAAGACGGA
GGAGATCTTCAGGCCAGCGGGAGGCGACATGCGCGACAACTGGCGCTCCGAGCTGTACAAGTACAAGGTGGTGGAGATCCAGCCC
```

Figure 3 continued

```
CTGGGCATCGCACCCACCGGGGCCAAGAGGCGGGTCGTGGAGCGCGAGAAGCGCGCGGCGGGCCTCGGCGCCCTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGAAGGACATCTGGGACAACATGACCTGGATGCAGTGGGAGCGCGAGAT
CTCCAACTACACCGAGACCATCTACATGCTCCTCGAGGACTCCCAGCGGCAGCAGGAGCGGAACGAGAAGGATCTGCTCGCGCTG
GACTCGTGGAACTCCCTGTGGAACTGGTTCAACATCACCAACTGGCTGTGGTACATCAAGATCTTCATCATGATCGTGGGCGGCC
TGATCGGCCTGCGCATCGTGTTCGCCGTGCTGTCGATCGTGAACCGCGTGCGCCAGGGCTACTCCCCGCTGTCCCTGCAAACGCT
GACCCCCAACCCCCGGGAGCCGGACAGGCTGGGTGGCATCGAGGAGGAGGGCGGCGAGCAGGACCGCGACCGCTCCATCCGCCTG
GTGTCCGGCTTCCTGCCCATCGTGTGGGACGACCTGCGCTCCCTGTGCCTGTTCTCGTACCACCGCCTGCGCGACTTCCTCCTGC
TGGCGGCCCGCGTCGTGGAGCTGCTGGGCCGGTCCTCCCTGCGGGGCCTGCAGCGCGGCTGGGAGGTGCTCAAGTACCTGGGCTC
GCTGGTGCAGTACTGGGGCCTGGAGCTGAAGAAGTCCGCCATCTCCCTGTTCGACACCATCGCCATCGCCGTGGCGGAGGGCACC
GACCGCATCCTCGAAGTGATCCAGCGCTTCTGCCGCGCCATCCGCAACATCCCCACCCGCATCCGCCAGGGCTTCGAGGCCTCGC
TCCTGTAGTAAGggtcctgaattcggtcaccggatcc
>CH848.3.d0611.20.14.optBF
gtcgacaagaaATGAAGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTCCTGGGGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGAGATGAAGAACTGCTCCTTCAACACGACGACGGAGATCCGCGACAAGGAGAAGAAGGAGTACGCCCTGTTCTACC
GGCCCGACATCGTGCCGCTGAACGAGACCAGCAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGCA
CACGCCCGTGGAGATCGTGTGCACCCGCCCGGGCAACAACACGCGCAAGTCCGTCCGGATCGGCCCTGGCCAGACCTTCTACGCC
ACCGGCGACATCATCGGCGACATCCGCCAGGCCCACTGCAACATCAGCGAGAAGCAGTGGAACGAGACCCTGCAGAAGGTGGGCA
AGGAGCTGCAGAAGCACTTCCCCAACAAGACGATTAAGTACGAGAGGTCGGCCGGCGGCGACATGGAGATCACCACGCACTCCTT
CAACTGCGGTGGCGAGTTCTTCTACTGCAACACGTCGAAGCTGTTCAACGGCACGTACAACGGGACCGACATCTCCACGAACTCG
TCCGCGAACTCGAACAGCACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCACGAACAGCTC
GGAGGAGATCTTCAGGCCAGCGGGAGGCGACATGCGCGACAACTGGCGCTCCGAGCTGTACAAGTACAAGGTGGTGGAGATCCAG
CCCCTGGGCATCGCCACCCACCGGGGCCAAGAGGCGGGTCGTGGAGCGCGAGAAGCGCGCGGCGGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCACGA
CCGCGGTGGCCTGGAACACGTCCTGGTCCAACAAGTCGGAGAAGGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTCGCG
CTGGACTCGTGGAACTCCCTGTGGAACTGGTTCAACATCACCAAGTGGCTGTGGTACATCAAGATCTTCATCATGATCGTGGGCG
GCCTGATCGGCCTGCGCATCGTGTTCGCCGTGCTGTCGATCGTGAACCGCGTGCGCCAGGGCTACTCCCCGCTGTCCCTGCAAAC
GCTGACCCCCAACCCCCGGGAGCCGGACAGGCTGGGTGGCATCGAGGAGGAGGGCGGCGAGCAGGACCGCGACCGCTCCATCCGC
CTGGTGTCCGGCTTCCTGCCCATCGTGTGGGACGACCTGCGCTCCCTGTGCCTGTTCTCGTACCACCGCCTGCGCGACTTCCTCC
TGCTGGCGGCCCGCGTCGTGGAGCTGCTGGGCCGGTCCTCCCTGCGGGGCCTGCAGCGCGGCTGGGAGGTGCTCAAGTACCTGGG
CTCGCTGGTGCAGTACTGGGGCCTGGAGCTGAAGAAGTCCGCCATCTCCCTGTTCGACACCCTGGCCATCGCCGTGGCGGAGGGC
ACCGACCGCATCATCAAAGTGATCCAGGGCTTCTGCCGCGCCATCCGCAACATCCCCACCCGCATCCGCCAGGGCTTCGAGGCCT
CGCTCCTGTAGTAAGggtcccgaattcggtaaccggatcc
>CH848.3.d0611.20.28.optBF
gtcgacaagaaATGCGGGTGATGGGCATCCTCAAGAACTGCCCGCAGTGGTGGATCTGGGGCATCCTGGGCTTCTGGATGCTCAT
GATCTGCAACGGCAAGGGCAAGCTCTGGGTGACGGTGTACTACGGCGTGCCGGTGTGGAAGGAGGCCAAGACGACCCTGTTCTGC
GCGTCGGACGCCCGCGCCTACGAGAAGGAGGTGCACAACGTGTGGGCGACCCACGCCTGCGTGCCCACGGACCCCAGCCCGCAGG
AGCTCGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGAGATGAAGAACTGCTCCTTCAACACGACGACGGAGATCCGCGACAAGGAGAAGAAGGAGTACGCCCTGTTCTACC
GGCCCGACATCGTGCCGCTGAACGAGACCAGCAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACAAGACC
```

Figure 3 continued

```
TTCAACGGGACCGGCCCGTGCAGCAAGGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGCA
CACGCCCGTGGAGATCGTGTGCACCCGCCCGGGCAACAACACGCGCAAGTCCGTCCGGATCGGCCCTGGCCAGACCTTCTACGCC
ACCGGCGACATCATCGGCGACATCCGCCAGGCCCACTGCAACATCAGCGAGGAGAAGTGGAACGAGACCCTGCAGAAGGTGGGCA
AGGAGCTGCAGAAGCACTTCCCCAACAAGACGATTAAGTACGCCCAGTCGGCCGGCGGCGACATGGAGATCACCACGCACTCCTT
CAACTGCGGTGGCGAGTTCTTCTACTGCAACACGTCGAAGCTGTTCAACGGGACGTACAACGGCGCCTACATCAACATCTCGACC
AACTCGAACAGCACGATCACGCTCCAGTGCCGCATCAAGCAGATCATCAACATGTGGCAGGGGGTGGGCCGCGCTATGTACGCAC
CGCCCATCGCCGGCAACATCACCTGCAAGTCCAACATCACCGGCCTCCTGCTGACCCGCGACGGCGGCACGAACAACAAGACGGA
GGAGATCTTCAGGCCAGCGGGAGGCGACATGCGCGACAACTGGCGCTCCGAGCTGTACAAGTACAAGGTGGTGGAGATCCAGCCC
CTGGGCATCGCACCCACCGGGGCCAAGAGGCGGGTCGTGGAGCGCGAGAAGCGCGCGGCGGGCCTCGGCGCCCTGTTCCTGGGCT
TCCTGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGAAGGACATCTGGGACAACATGACCTGGATGCAGTGGGAGCGCGAGAT
CTCCAACTACACCGAGACCATCTACATGCTCCTCGAGGACTCCCAGCGGCAGCAGGAGCGGAACGAGAAGGATCTGCTCGCGCTG
GACTCGTGGAACTCCCTGTGGAACTGGTTCAACATCACCAACTGGCTGTGGTACATCAAGATCTTCATCATGATCGTGGGCGGCC
TGATCGGCCTGCGCATCGTGTTCGCCGTGCTGTCGATCGTGAACCGCGTGCGCCAGGGCTACTCCCCGCTGTCCCTGCAAACGCT
GACCCCCAACCCCCGGGAGCCGGACAGGCTGCGTGGCATCGAGGAGGAGGGCGGCGAGCAGGACCGCGACCGCTCCATCCGCCTG
GTGTCCGGCTTCCTGCCCATCGTGTGGGACGACCTGCGCTCCCTGTGCCTGTTCTCGTACCACCGCCTGCGCGACTTCCTCCTGC
TGGCGGCCCGCGTCGTGGAGCTGCTGGGCCGGTCCTCCCTGCGGGGCCTGCAGCGCGGCTGGGAGGTGCTCAAGTACCTGGGCTC
GCTGGTGCAGTACTGGGGCCTGGAGCTGAAGAAGTCCGCCATCTCCCTGTTCGACACCCTGGCCATCGCCGTGGCGGAGGGCACC
GACCGCATCATCGAAGGCATCCAGCGCTTCTGCCGCGCCATCCGCAACATCCCCACCCGCATCCGCCAGGGCTTCGAGGCCTCGC
TCCTGTAGTAAGaggacccgaattcggtaaccggatcc
>CH848.3.d0700.15.06.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCGTCCTGAAGAACGTGACCGAGAACTTCAACATGTGGAAGAACAACCGGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGGACAACCGC
ACCGTCGGGGAGATGAAGAACTGCTCCTTCAACACGACGACGGAGATCCGCGACAAGGAGAAGAAGGAGTACGCCCTGTTCTACA
AGCCCGACGTCGTGCCGCTGGACGAGACCAACAACACCTCGGAGTACAGGCTGATCAACTGCAACACCTCCGCGGTCACGCAGGC
GTGCCCCAAGGTCACGTTCGAGCCCATCCCCATCCACTACTGCGCCCCGCCGGCTACGCCATCCTGAAGTGCAACAACGAGACC
TTCAACCGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGAA
CACGCCCGTGGAGATCGTGTGCACCCGCCCGAACAACAACACGCGCAAGTCCGTCCGGATCGGCCCTGGCCAGACCTTCTACGCC
ACCGGCGACATCATCGGCGACATCCGCCAGGCCCACTGCAACATCAGCGAGGGGGATTGGAACGAGACCCTGCAGAAGGTGGGCA
AGGAGCTGCAGAAGCACTTCCCCAACAAGACGATTAAGTACGAGCAGTCGGCCGGCGGCGACATGGAGATCACCACGCACTCCTT
CAACTGCGGTGGCGAGTTCTTCTACTGCAACACGTCGAAGCTGTTCAACGGCACGTACAACGGCACCTACATCTCCACGAACTCG
TCCACCAACTCGACGAGCACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCACGAACAGCTC
GGAGGAGATCTTCAGGCCAGCGGGAGGCGACATGCGCGACAACTGGCGCTCCGAGCTGTACAAGTACAAGGTGGTGGAGATCCAG
CCCCTGGGCATCGCACCCACCGGGGCCAAGAGGCGGGTCGTGGAGCGCGAGAAGCGCGCGGCGGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCACGA
CCAACGTGCCCTGGAACACGTCCTGGTCCAACAAGTCGGAGAAGGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTCGCG
CTGGACTCGTGGAACTCCCTGTGGAACTGGTTCAACATCACCAAGTGGCTGTGGTACATCAAGATCTTCATCATGATCGTGGGCG
GCCTGATCGGCCTGCGCATCGTGTTCGCCGTGCTGTCGATCGTGAACCGCGTGCGCCAGGGCTACTCCCCGCTGTCCCTGCAAAC
GCTGACCCCCAACCCCCGGGAGCCGGACAGGCTGGGTGGCATCGAGGAGGAGGGCGGCGAGCAGGACCGCGACCGCTCCATCCGC
CTGGTGTCCGGCTTCCTGCCCATCGTGTGGGACGACCTGCGCTCCCTGTGCCTGTTCTCGTACCACCGCCTGCGCGACTTCCTCC
TGCTGGCGGCCCGCGTCGTGGAGCTGCTGGGCCGGTCCTCCCTGCGGGGCCTGCAGCGCGGCTGGGAGGTGCTCAAGTACCTGGG
CTCGCTGGTGCAGTACTGGGGCCTGGAGCTGAAGAAGTCCGCCATCTCCCTGTTCGACACCCTGGCCATCGCCGTGGCGGAGGGC
ACCGACCGCATCATCGAGCTCATCCAGCGGTCGTGCCGCGCCATCCGCAACATCCCCACCCGCATCCGCCAGGGCTTCGAGGCCT
CGCTCCTGTAGTAAGaggtcccgaattcggtaaccggatcc
```

Figure 3 continued

\>CH848.3.d0700.15.15.optBF
gtcgacaagaaATGCGGGTGACGGGCATCCTCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGACTCGCGGTCCAACGACAACGTGACCTCGATCAACAACACGATCATGGGGGAGATGAAGAACTGCTCCTTCAACA
CGACGACGGAGATCCGCGACAAGGAGAAGAAGGAGTACGCCCTGTTCTACCGCCCCGACATCGTGCCGCTGAACGAGACCAGCAA
CACCTCGGAGTACAGGCTGATCAACTGCAACACCTCCGCGGTCACGCAGGCGTGCCCCAAGGTCACGTTCGAGCCCATCCCCATC
CACTACTGCGCCCCCGCCGGCTACGCCATCCTGAAGTGCAACGACGAGACCTTCAACGGGACCGGCCCGTGCAGCAACGTGTCCA
CCGTGCAGTGCACGCACGGCATCCGGCCCGTGGTGTCCACGCAGCTGCTCCTGAACGGGTCGCTGGCGGAGAAGGAGATCGTCAT
CCGGTCCGAGAACCTCACGAACAACGCGAAGATCATCATCGTGCACCTGCACACGCCCGTGGAGATCGTGTGCACCCGCCCGGGC
AACAACACGCGCAAGTCCGTCCGGATCGGCCCTGGCCAGACCTTCTACGCCACCGGCGACATCATCGGCGACATCCGCCAGGCCC
ACTGCAACATCAGCGAGGAGAAGTGGAACAAGACCCTGCAGAAGGTGGGCAAGGAGCTGCAGAAGCACTTCCCCAACAAGACGAT
TAAGTACGAGCGCCCCGCCGGCGGCGACCTGGAGATCACCACGCACTCCTTCAACTGCGGTGGCGAGTTCTTCTACTGCAACACG
TCGAAGCTGTTCAACGGCACGTACAACGGCACCGACATCTCCACGAACTCGTCCACCAACTCGACGAGCACGATCACGCTCCAGT
GCCGCATCAAGCAGATCATCAACATGTGGCAGGGGGTGGGCCGCGCTATGTACGCACCGCCCATCGCCGGCAACATCACCTGCAA
GTCCAACATCACCGGCCTCCTGCTGACCCGCGACGGCGGCACGAACAGCTCGGAGGAGATCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCCAAGAGGC
GGGTCGTGGAGCGCGAGAAGCGCGCGGCGGGCCTCGGCGCCCTGTTCCTGGGCTTCCTGGGCGCTGCGGGCTCCACCATGGGTGC
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACGACCAACGTGCCCTGGAACACGTCCTGGTCCAACAA
GTCGGAGAAGGACATCTGGGACAACATGACCTGGATGCAGTGGGAGCGCGAGATCTCCAACTACACCGAGACCATCTACAAGCTC
CTCGAGGACTCCCAGAACCAGCAGGAGCGGAACGAGAAGGATCTGCTCGCGCTGGACTCGTGGAACTCCCTGTGGAACTGGTTCA
ACATCACCAAGTGGCTGTGGTACATCAAGATCTTCATCATCATCGTCGGCGGCCTGATCGGCCTGCGCATCGTGTTCGCCGTGCT
GTCGATCGTGAACCGCGTGCGCCAGGGCTACTCCCCGCTGTCCCTGCAAACGCTGACCCCCAACCCCGGGAGCCGGACAGGCTG
GGTGGCATCGAGGAGGAGGGCGGCGAGCAGGACCGCGACCGCTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCG
GTCCTCCCTGCGGGGCCTGCAGCGCGGCTGGGAGGTGCTCAAGTACCTGGGCTCGCTGGTGCAGTACTGGGGCCTGGAGCTGAAG
AAGTCCGCCATCTCCCTGTTCGACACCATCGCCATCGCCGTGGCGGAGGGCACCGACCGCATCCTGGAGGTCATCCAGCGGTTCT
GCCGCGCCATCCGCAACATCCCCACCCGCATCCGCCAGGGCTTCGAGGCCTCGCTCCTGTAGTAAGggacctgaattcggtaacc
ggatcc
\>CH848.3.d0700.15.29.optBF
gtcgacaagaaATGCGGGTGATGGGCATCCTCAAGAACTACCCGCAGTGGTGGATCTGGGGCATCCTGGGCTTCTGGATGCTCAT
GATCTGCAACGGCAAGGGGAAGCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTGCTGGGGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACGACTCGCGGTCCAACGACAACGTGACCTCGATCAACAACACGATCATGGGGGAGATGAAGAACTGCTCCTTCAACA
CGACGACGGAGATCCGCGACAAGGAGAAGAAGGAGTACGCCCTGTTCTACCGCCCCGACATCGTGCCGCTGAACGAGAACGAGAC
CAGCAACACCTCGGAGTACAGGCTGATCAACTGCAACACCTCCGCGGTCACGCAGGCGTGCCCCAAGGTCACGTTCGAGCCCATC
CCCATCCACTACTGCGCCCCCGCCGGCTACGCCATCCTGAAGTGCAACAACGAGACCTTCAACGGGACCGGCCCGTGCAGCAACG
TGTCCACCGTGCAGTGCACGCACGGCATCCGGCCCGTGGTGTCCACGCAGCTGCTCCTGAACGGGTCGCTGGCGGAGAAGGAGAT
CGTCATCCGGTCCGAGAACCTCACGAACAACGCGAAGATCATCATCGTGCACCTGCACACGCCCGTGGAGATCGTGTGCACCCGC
CCGGGCAACAACACGCGCAAGTCCGTCCGGATCGGCCCTGGCCAGACCTTCTACGCCACCGGCGACATCATCGGCGACATCCGCC
AGGCCCACTGCAACATCAGCGAGGAGAAGTGGAACGAGACCCTGCAGAAGGTGGGCAAGGAGCTGCAGAAGCACTTCCCCAACAA
GACGATTAAGTACGCGCAGTCGGCCGGCGGCGACATGGAGATCACCACGCACTCCTTCAACTGCGGTGGCGAGTTCTTCTACTGC
AACACGTCGAACCTGTTCAACGGCACGTACAACGGCACCTACATCTCCACGAACTCGTCCGCCAACTCGACGAGCACGATCACGC
TCCAGTGCCGCATCAAGCAGATCATCAACATGTGGCAGGGGGTGGGCCGCGCTATGTACGCACCGCCCATCGCCGGCAACATCAC
CTGCAAGTCCAACATCACCGGCCTCCTGCTGACCCGCGACGGCGGCACGAACAACACCAGCAACGAGGAGACGTTCAGGCCAGCG
GGAGGCGACATGCGCGACAACTGGCGCTCCGAGCTGTACAAGTACAAGGTGGTGGAGATCCAGCCCCTGGGCATCGCACCCACCG
GGGCCAAGAGGCGGGTCGTGGAGCGCGAGAAGCGCGCGGCGGGCCTCGGCGCCCTGTTCCTGGGCTTCCTGGGCGCTGCGGGCTC
CACCATGGGTGCCGCGTCCATCACCCTGACCGTGCAGGCCCGCCAGCTGCTCTCCGGCATCGTGCAGCAGCAGTCCAACCTCCTG
AGGGCCATCGAGGCCCAGCAGCACATGCTGCAGCTGACCGTGTGGGGCATCAAGCAGCTGCAGGCCAGGGTGCTCGCGCTCGAGC

Figure 3 continued

```
GCTACCTGAAGGACCAGCAGCTGCTCGGCATGTGGGGCTGCTCCGGCAAGCTGATCTGCACGACCGCCGTGCCCTGGGACTCGTC
CTGGTCCAACAAGTCGGAGAAGGACATCTGGGACAACATGACCTGGATGCAGTGGGAGCGCGAGATCTCCAACTACACCGAGACC
ATCTACAAGCTCCTCGAGGACTCCCAGAACCAGCAGGAGCGGAACGAGCAGGATCTGCTCGCGCTGGACTCGTGGAACTCCCTGT
GGAACTGGTTCAACATCACCAACTGGCTGTGGTACATCAAGATCTTCATCATGATCGTCGGCGGCCTGATCGGCCTGCGCATCGT
GTTCGCCGTGCTGTCGATCGTGAACCGCGTGCGCCAGGGCTACTCCCCGCTGTCCCTGCAAACGCTGACCCCCAACCCCCGGGAG
CCGGACAGGCTGGGTGGCATCGAGGAGGAGGGCGGCGAGCAGGACCGCGACCGCTCCATCCGCCTGGTGTCCGGCTTCCTGCCCA
TCGTGTGGGACGACCTGCGCTCCCTGTGCCTGTTCTCGTACCACCGCCTGCGCGACTTCCTCCTGCTGGCGGCCCGCGTCGTGGA
GCTGCTGGGCCGGTCCTCCCTGCGGGGCCTGCAGCGCGGCTGGGAGGTGCTCAAGTACCTGGGCTCGCTGGTGCAGTACTGGGGC
CTGGAGCTGAAGAAGTCCGCCATCTCCCTGTTCGACACCATCGCCATCGCCGTGGCGGAGGGCACCGACCGCATCCTGGAGGTCA
TCCAGGGCTTCTGCCGCGCCATCCGCAACATCCCCACCCGCATCCGCCAGGGCTTCGAGGCCTCGCTCCTGTAGTAAGggtcctg
aattcggtaaccggatcc
>CH848.3.d0700.27.06.optBF
gtcgacaagaaATGCGGGTGATGGGCATCCTCAAGAACTACCCGCAGTGGTGGATCTGGGGCATCCTGGGCTTCTGGATGCTCAT
GATCTGCAAGGGCAAGGGGAACCTCTGGGTGACGGTGTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAACAACCGC
ACCGTCTACAGAGATGAAGAACTGCTCCTTCAACACGACGACGGAGATCCGCGACAAGGAGAAGAAGGAGTACGCCCTGTTCTACC
GCTCGGACGTCGTGCCGCTGGACGAGACCAACAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGCA
CACGCCCGTGGAGATCGTGTGCACCCGCCCGGGCAACAACACGCGCAAGTCCGTCCGGATCGGCCCTGGCCAGACCTTCTACGCC
ACCGGCGACATCATCGGCGAGATCCGCCAGGCCCACTGCAACATCAGCGAGTCGAAGTGGAACGAGACCCTGCAGAAGGTGGGCA
AGGAGCTGCAGAAGCACTTCCCCAACAAGACGATTAAGTACGAGCGCTCGGCCGGCGGCGACATGGAGATCACCACGCACTCCTT
CAACTGCGGTGGCGAGTTCTTCTACTGCAACACGTCGAAGCTGTTCAACGGCACGTACAACGGCACCGACATCTCCACGAACTCG
TCCGCCAACTCGAACAGCACGATCACGCTCCAGTGCCGCATCAAGCAGATCATCAACATCTGGCAGGGGGTGGGCCGCGCTATGT
ACGCACCGCCCATCGCCGGCAACATCACCTGCAAGTCCAACATCACCGGCCTCCTGCTGACCCGCGACGGCGGCAACAACAACAA
CCGGAACGAGGAGACGTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGAGGCGGGTCGTGGAGCGCGAGAAGCGCGCGGCGGGCCTCGGCGCCCTGT
TCCTGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGATCT
GCACGACCAACGTGCCCTGGAACACGTCCTGGTCCAACAAGTCGGAGAAGGACATCTGGGACAACATGACCTGGATGCAGTGGGA
GCGCGAGATCTCCAACTACACCGAGACCATCTACATGCTCCTCGAGGACTCCCAGCGGCAGCAGGAGCGGAACGAGAAGGATCTG
CTCGCGCTGGACTCGTGGAACTCCCTGTGGAACTGGTTCAACATCACCAACTGGCTGTGGTACATCAAGATCTTCATCATGATCG
TCGGCGGCCTGATCGGCCTGCGCATCGTGTTCGCCGTGCTGTCGATCGTGAACCGCGTGCGCCAGGGCTACTCCCCGCTGTCCCT
GCAAACGCTGACCCCCAACCCCCGGGAGCCGGACAGGCTGCGTGGCATCGAGGAGGAGGGCGGCGAGCAGGACCGCGACCGCTCC
ATCCGCCTGGTGTCCGGCTTCCTGCCCATCGTGTGGGACGACCTGCGCTCCCTGTGCCTGTTCTCGTACCACCGCCTGCGCGACT
TCCTCCTGCTGGCGGCCCGCGTCGTGGAGCTGCTGGGCCGGTCCTCCCTGCGGGGCCTGCAGCGCGGCTGGGAGGTGCTCAAGTA
CCTGGGCTCGCTGGTGCAGTACTGGGGCCTGGAGCTGAAGAAGTCCGCCATCTCCCTGTTCGACACCCTGGCCATCGCCGTGGCG
GAGGGCACCGACCGCATCATCGAGGTCATCCAGGGCTTCTGCCGCGCCATCCGCAACATCCCCACCCGCATCCGCCAGGGCTTCG
AGGCCTCGCTCCTGTAGTAAGggtcccgaattcggttaccggatcc
>CH848.3.d0794.5.27.optBF
gtcgacaagaaATGCGGGTGATGGGCATCCCCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCCGGGCCTACGAGAAGGAGGTGCACAACGTGTGGGCGACCCACGCCTGCGTGCCCACGGACCCCAGCCCGCAGG
AGCTCGTCCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGGACAACCGC
ACCGTCGGCGAGATGAAGAACTGCTCCTTCAACACGACGACGGAGATCCGCGACAAGGAGAAGAAGGAGTACGCCCTGTTCTACC
GCCCGGACATCGTGCCGCTGTCCGAGACCAACAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGAA
CACGCCCGTGGAGATCGTGTGCACCCGCCCGAACAACAACACGCGCAAGTCCGTCCGGATCGGCCCTGGCCAGACCTTCTACGCC
```

Figure 3 continued

```
ACCGGCGACATCATCGGCGAGATCAAGCAGGCCCACTGCAACATCAGCGAGGAGAAGTGGAACGAGACCCTGCAGAAGGTGGGCA
AGGAGCTGCAGAAGCACTTCCCCAACAAGATCATTAAGTACGCCCAGTCGGCCGGCGGCGACATGGAGATCACCACGCACTCCTT
CAACTGCGGTGGCGAGTTCTTCTACTGCAACACGGCGAACCTGTTCAACGGCACGTACAACGGCACCGACATCTCCACGAACTCG
TCCACCAAGTCGAACAGCACGATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCACCATCACCGGCCTCCTGCTGACCCGCGACGGCGGCACGAACTCGAG
CAAGACGGAGGAGGAGACGTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGAAGACCGACATCTGGGACAACATGACCTGGATGCAGTG
GGAGCGCGAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGGGCGGCATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCATCGCCATCGCCGTG
GCGGAGGGCACCGACCGCATCATCGAGGCGATCCAGGGCTTCTGCCGCGCCATCCGCAACATCCCCACCCGCATCCGCCAGGGCT
TCGAGGCCTCGCTCCTGTAGTAAGagggaccccgaattcggttaccggatcc
>CH848.3.d0794.5.41.optBF
gtcgacaagaaATGCGGGTGATGGGCATCCTCAAGAACTACCCGCAGTGGTGGATCTGGGGCATCCTGGGCTTCTGGATGCTCAT
GATCTGCAACGGCAAGGAGAACCTCTGGGTGACGGTGTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACCGC
ACCGTCGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGGTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACAACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GAACACGCCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGGCAGGCCCACTGCAACATCAGCGAGAAGGAGTGGAACGACACCCTGCAGAAGGTGG
GCAAGGAGCTGCAGAAGCACTTCCCCAACAAGACCATTGAGTACAAGCAGTCGGCCGGCGGCGACATGGAGATCACCACGCACTC
CTTCAACTGCGGTGGCGAGTTCTTCTACTGCAACACGTCCAACCTGTTCAACGGCACGTACAACGGCACCTACATGAACATCTCC
ACCGACTCGAACAGCACGATCACGCTCCAGTGCCGCATCAAGCAGATCATCAACATGTGGCAGGGGGTGGGCCGCGCTATGTACG
CACCGCCCATCGCCGGCAACATCACCTGCCGGTCCAACATCACCGGCCTCCTGCTGACCCGCGACGGCGGCACGAACTCGAGCAA
GACGGAGGAGGAGACGTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGAGGCGGGTCGTGGAGCGCGAGAAGCGCGCGGCGGGCCTCGGCGCCCTGT
TCCTGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGATCT
GCACGACCAACGTGCCCTGGAACACGTCCTGGTCCAACAAGTCGGAGAAGGACATCTGGGACAACATGACCTGGATGCAGTGGGA
GCGCGAGATCTCCAACTACACCGAGACCATCTACAAGCTCCTCGAGGACTCCCAGAACCAGCAGGAGCGGAACGAGCAGGATCTG
CTCGCGCTGGACTCGTGGAACTCCCTGTGGAACTGGTTCAACATCACCAAGTGGCTGTGGTACATCAAGATCTTCATCATGATCG
TCGGCGGCCTGATCGGCCTGCGCATCGTGTTCGCCGTGCTGTCGATCGTGAACCGCGTGCGCCAGGGCTACTCCCCGCTGTCCCT
GCAAACGCTGACCCCCAACCCCCGGGAGCCGGACAGGCTGCGCGGCATCGAGGAGGAGGGCGGCGAGCAGGACCGCGACCGCTCC
ATCCGCCTGGTGTCCGGCTTCCTGCCCATCGTGTGGGACGACCTGCGCTCCCTGTGCCTGTTCTCGTACCACCGCCTGCGCGACT
TCCTCCTGCTGGCGGCCCGCGTCGTGGAGCTGCTGGGCCGGTCCTCCCTGCGGGGCCTGCAGCGCGGCTGGGAGGTGCTCAAGTA
CCTGGGCTCGCTGGTGCAGTACTGGGGCCTGGAGCTGAAGAAGTCCGCCATCTCCCTGTTCGACACCATCGCCATCGCCGTGGCG
GAGGGCACCGACCGCATCATCGGGGTCATCCAGCGGGTGTGCCGCGCCATCCGCAACATCCCCACCCGCATCCGCCAGGGCTTCG
AGGCCTCGCTCCTGTAGTAAGaggtcccgaattcggttaccggatcc
>CH848.3.d0836.10.36.optBF
gtcgacaagaaATGCGGGTGATGGGCATCCTCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
```

Figure 3 continued

```
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACTCC
ACCGTCGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGGGATCGTCATCCGGTCCGAGAACCTCACGAACAACGCGAAGATCATCATCGTGCACCT
GCACACGCCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGGCAGGCCCACTGCAACATCAGCGAGTCCAAGTGGAACGAGACCCTGCAGAAGGTGG
GCAAGGAGCTGCAGAAGCACTTCCCCAACAAGACCATTAAGTACGAGCAGTCGGCCGGCGGCGACATGGAGATCACCACGCACTC
CTTCAACTGCGGTGGCGAGTTCTTCTACTGCACCACGTCCAAGCTGTTCAACGGGACGTACAACGGCACGGACATCTCCACGAAC
TCCTCGGCGAACTCGAACCCGACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCACGAACTC
GAGCGGGAAGGAGGAGATCTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGACCGACATCTGGGACAACATGACCTGGATGCAGTG
GGAGCGCGAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCGCTGTC
CCTGCAAACGCTGACCCCCAACCCCCGGGAGCCGGACAGGCTGGGCGGCATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCATCGCCGTG
GCGGAGGGCACCGACCGCATCATCGAGCTCATCCAGGGGTTCTGCCGCGCCATCCGCAACATCCCCACCCGCATCCGCCAGGGCT
TCGAGGCCTCGCTCCTGTAGTAAGggacctgaattcggttaccggatcc
>CH848.3.d0864.7.26.optBF
gtcgacaagaaATGCGCGTGACCGGCATCCTCAAGAACTACCCGCAGTGGTGGATCTGGGGCATCCTGGGCTTCTGGATGCTCAT
GAACTGCAACGGCAAGGAGAACCTCTGGGTGACGGTGTACTACGGCGTGCCGGTGTGGAAGGAGGCCAAGACGACCCTGTTCTGC
GCGTCGGACGCCCGGGCCTACGAGAAGGAGGTGCACAACGTGTGGGCGACCCACGCCTGCGTGCCCACGGACCCCAGCCCGCAGG
AGCTCGTGCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACTCC
ACGGTGGACGAGATGAAGAACTGCTCCTTCAACACGACGACGGAGATCCGCGACAAGGAGAAGAAGGAGTACGCCCTGTTCTACC
GCCCGGACATCGTGCCGCTGAACGAGAACGAGACGTCGAACACCTCGGAGTACAGGCTGATCAACTGCAACACCTCCGCGGTCAC
GCAGGCGTGCCCCAAGGTCACGTTCGAGCCCATCCCCATCCACTACTGCGCCCCCGCCGGCTACGCCATCCTGAAGTGCAACGAC
GAGACCTTCAACGGGACCGGCCCGTGCAGCAACGTGTCCACCGTGCAGTGCACGCACGGCATCCGGCCCGTGGTGTCCACGCAGC
TGCTCCTGAACGGGTCGCTGGCGGAGAAGGAGATCGTCATCCGGTCCGAGAACCTCACGAACAACGCGAAGATCATCATCGTGCA
CCTGAACACGCCCGTGGAGATCGTGTGCACCCGCCCGAACAACAACACGCGCAAGTCCGTCCGGATCGGCCCTGGCCAGACCTTC
TACGCCACCGGCGACATCATCGGCGACATCCGGCAGGCCCACTGCAACATCAGCGAGAAGGAGTGGAACGAGACCCTGCAGAAGG
TGGGCAAGGAGCTGCAGAAGCACTTCCCCAACAAGACCATTAAGTACGCGCAGTCGGCCGGCGGCGACATGGAGATCACCACGCA
CTCCTTCAACTGCGGTGGCGAGTTCTTCTACTGCAACACGGCCAACCTGTTCAACGGGACGTACAACGGCACGGACATCTCCACG
AACTCCTCGACGAAGTCGAACTCGACGATCACGCTCCAGTGCCGCATCAAGCAGATCATCAACATGTGGCAGGGGGTGGGCCGCG
CTATGTACGCACCGCCCATCGCCGGCAACATCACCTGCCGGTCCACCATCACCGGCCTCCTGCTGACCCGCGACGGCGGCAACAA
CTCGAGCAAGACGGAGGAGGAGACCTTCAGGCCAGCGGGAGGCGACATGCGCGACAACTGGCGCTCCGAGCTGTACAAGTACAAG
GTGGTGGAGATCCAGCCCCTGGGCATCGCACCCACCGGGGCCAAGAGGCGGGTCGTGGAGCGCGAGAAGCGCGCGGCGGGCCTCG
GCGCCCTGTTCCTGGGCTTCCTGGGCGCTGCGGGCTCCACCATGGGTGCCGCGTCCATCACCCTGACCGTGCAGGCCCGCCAGCT
GCTCTCCGGCATCGTGCAGCAGCAGTCCAACCTCCTGAGGGCCATCGAGGCCCAGCAGCACATGCTGCAGCTGACCGTGTGGGGC
ATCAAGCAGCTGCAGGCCAGGGTGCTCGCGCTCGAGCGCTACCTGAAGGACCAGCAGCTGCTCGGCATGTGGGGCTGCTCCGGCA
AGCTGATCTGCACGACCAACGTGCCCTGGAACACGTCCTGGTCCAACAAGTCGAAGACCGACATCTGGGACAACATGACCTGGAT
GCAGTGGGAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGAACTGGTTCAACATCACCAAGTGGCTGTGGTACATCAAGATCTTCA
TCATGATCGTCGGCGGCCTGATCGGCCTGCGCATCGTGTTCGCCGTGCTGTCGATCGTGAACCGCGTGCGCCAGGGCTACTCCCC
```

Figure 3 continued

```
GCTGTCCCTGCAAACGCTGACCCCCAACCCCCGGGAGCCGGACAGGCTGCGCGGCATCGAGGAGGAGGGCGGCGAGCAGGACCGC
GACCGCTCCATCCGCCTGGTGTCCGGCTTCCTGCCCATCGTGTGGGACGACCTGCGCTCCCTGTGCCTGTTCTCGTACCACCGCC
TGCGCGACTTCCTCCTGCTGGCGGCCCGCGTCGTGGAGCTGCTGGGCCGGTCCTCCCTGCGGGGCCTGCAGCGCGGCTGGGAGGT
GCTCAAGTACCTGGGCTCGCTGGTGCAGTACTGGGGCCTGGAGCTGAAGAAGTCCGCCATCTCCCTGTTCGACACCCTCGCCATC
GCCGTGGCGGAGGGCACCGACCGCATCATCGAAGTGATCCAGGGGTTCTGCCGCGCCATCCGCAACATCCCCCGCCGCATCCGCC
AGGGCTTCGAGGCCTCGCTCCTGTAGTAAGggtcctgaattcggttaccggatcc
>CH848.3.d0864.7.39.optBF
gtcgacaagaaATGCGCGTGATGGGCATCCCCAAGAACTGCCCGCAGTGGTGGATCTGGGGCATCCTGGGCTTCTGGATGCTCAT
GATCTGCAACGGCAAGGGGAAGCTCTGGGTGACGATCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACTCC
ACGGTGGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GAACACGCCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGGCAGGCCCACTGCAACATCAGCGAGAAGGAGTGGAACGACACCCTGCAGAAGGTGG
GCAAGGAGCTGCAGAAGCACTTCCCCAACAAGACCATTGAGTACAAGCGATCGGCCGGCGGCGACATGGAGATCACCACGCACTC
CTTCAACTGCGGTGGCGAGTTCTTCTACTGCAACACGGCCAAGCTGTTCAACGGGACGTACAACGGCACGGACATCTCCACGAAC
TCCTCGGCGGACTCGAACTCGACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCCACATCACCGGCCTCCTGCTGACCCGCGACGGCGGCACCAACTC
GAGCGAGGAGGAGGAGATCTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGACCGACATCTGGGACAACATGACCTGGATGCAGTG
GGAGCGCGAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGCGCGAGATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCATCGCCGTG
GCGGAGGGCACCGACCGCATCATCGAACTCATCCAGGGGTTCTGCCGCGCCATCCGCAACATCCCCACCCGCATCCGCCAGGGCT
TCGAGGCCTCGCTCCTGTAGTAAGaattcggtgaccgggacccggatcc
>CH848.3.d0893.10.06.optBF
gtcgacaagaaATGCGCGTGACGGGCATCCTCAAGAACTACCCGCAGTGGTGGATCTGGGGCATCCTGGGCTTCTGGATGCTCAT
GAACTGCAACGGCAAGGAGAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACTCC
ACGGTGGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACACGCCCGTGGAGATCGTGTGCACCCGCCCGAACAACAACACGCGCAAGTCCGTCCGGATCGGCCCTGGCCAGACCTTCTAC
GCCACCGGCGACATCATCGGCGACACGCGGCAGGCCCACTGCAACATCAGCGAGAAGAAGTGGAACGAGACCCTGCAGAAGGTGG
GCATCGAGCTGCAGAAGCACTTCCCCAACAAGACCATTAAGTACAACCAGTCGGCCGGCGGCGACATGGAGATCACCACGCACTC
CTTCAACTGCGGTGGCGAGTTCTTCTACTGCAACACGTCGAACCTGTTCAACGGGACGTACAACGGCACCTACATCTCCACGAAC
TCCTCGGCGAACTCGACCTCGACGATCACGCTCCAGTGCCGCATCAAGCAGATCATCAACATGTGGCAGGGGGTGGGCCGCGCTA
TGTACGCACCGCCCATCGCCGGCAACATCACCTGCCGGTCCAACATCACCGGCCTCCTGCTGACCCGCGACGGCGGCACCAACTC
```

Figure 3 continued

```
GAACGAGACGGAGACCTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGAGGCGGGTCGTGGAGCGCGAGAAGCGCGCGGCGGGCCTCGGCGCCCTGT
TCCTGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGATCT
GCACGACCAACGTGCCCTGGAACACGTCCTGGTCCAACAAGTCGGAGACCGACATCTGGGACAACATGACCTGGATGCAGTGGGA
GCGCGAGATCTCCAACTACACCGAGACCATCTACAAGCTCCTCGAGGACTCCCAGAACCAGCAGGAGCGGAACGAGCAGGATCTG
CTCGCGCTGGACTCGTGGAACTCCCTGTGGAACTGGTTCTCGATCACCAAGTGGCTGTGGTACATCAAGATCTTCATCATGATCG
TCGGCGGCCTGATCGGCCTGCGCATCGTGTTCGCCGTGCTGTCGATCGTGAACCGCGTGCGCCAGGGCTACTCCCCGCTGTCCCT
GCAAACGCTGACCCCCAACCCCCGGGAGCCGGACAGGCTGCGCGGGATCGAGGAGGAGGGCGGCGAGCAGGACCGCGACCGCTCC
ATCCGCCTGGTGTCCGGCTTCCTGCCCATCGTGTGGGACGACCTGCGCTCCCTGTGCCTGTTCTCGTACCACCGCCTGCGCGACT
TCCTCCTGCTGGCGGCCCGCGTCGTGGAGCTGCTGGGCCGGTCCTCCCTGCGGGGCCTGCAGCGCGGCTGGGAGGTGCTCAAGTA
CCTGGGCTCGCTGGTGCAGTACTGGGGCCTGGAGCTGAAGAAGTCCGCCATCTCCCTGTTCGACACCCTCGCCATCGCCGTGGCG
GAGGGCACCGACCGCATCATCGAACTCATCCAGGGGTTCTGCCGCGCCATCCGCAACATCCCCACCCGCATCCGCCAGGGCTTCG
AGGCCTCGCTCCTGTAGTAAGaattcggtcaccgggacccggatcc
>CH848.3.d1120.10.13.optBF
gtcgacaagaaATGCGCGTGACGGGCATCCTCAAGAACTACCCGCAGTGGTGGATCTGGGGCATCCTGGGCTTCTGGATGCTCAT
GAACTGCAACGGCAAGGAGAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGCACGCCACGGTGGAGAACTCC
ACGACCGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACACGCCCGTGGAGATCGTGTGCACCCGCCCGAACAACAACACGCGCAAGTCCGTCCGGATCGGCCCTGGCCAGACCTTCTAC
GCCACCGGCGGCATCATCGGCGAGATCCGGCAGGCCCACTGCAACATCAGCAAGGAGACCTGGAACGACACCCTGCAGAAGGTGG
GCAAGGAGCTGCAGAAGCACTTCCCCAACAAGACCATCCGCTACAACCAGTCGGCCGGCGGCGACATGGAGATCACCACGCACTC
CTTCAACTGCGGTGGCGAGTTCTTCTACTGCAACACGGCCAAGCTGTTCAACTCGACGTACAACGGCACCTACATCTCCACGAAC
TCCACGAACTCGACCTCGTACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCACCAACTCGTC
GGAGGAGGAGATCTTCAGGCCAGCGGGAGGCGACATGCGCGACAACTGGCGCTCCGAGCTGTACAAGTACAAGGTGGTGGAGGTG
CAGCCCCTGGGCATCGCACCCACCGGGGCCAAGAGGCGGGTCGTGGAGCGCGAGAAGCGCGCGGCGGGCCTCGGCGCCCTGTTCC
TGGGCTTCCTGGGCGCTGCGGGCTCCACCATGGGTGCCGCGTCCATCACCCTGACCGTGCAGGCCCGCCAGCTGCTCTCCGGCAT
CGTGCAGCAGCAGTCCAACCTCCTGAGGGCCATCGAGGCCCAGCAGCACATGCTGCAGCTGACCGTGTGGGGCATCAAGCAGCTG
CAGGCCAGGGTGCTCGCGCTCGAGCGCTACCTGAAGGACCAGCAGCTGCTCGGCATGTGGGGCTGCTCCGGCAAGCTGATCTGCA
CGACCAACGTGCCCTGGAACACGTCCTGGTCCAACAAGTCGGAGACCGACATCTGGGACAACATGACCTGGATGCAGTGGGAGCG
CGAGATCTCCAACTACACCGAGACCATCTACAAGCTCCTCGAGGACTCCCAGAACCAGCAGGAGCGGAACGAGCAGGATCTGCTC
GCGCTGGACTCGTGGAACTCCCTGTGGAACTGGTTCTCGATCACCAAGTGGCTGTGGTACATCAAGATCTTCATCATGATCGTCG
GCGGCCTGATCGGCCTGCGCATCGTGTTCGCCGTGCTGTCGATCGTGAACCGCGTGCGCCAGGGCTACTCCCCGCTGTCCCTGCA
AACGCTGACCCCCAACCCCCGGGAGCCGGACAGGCTGCGCGGGATCGAGGAGGAGGGCGGCGAGCAGGACCGCGACCGCTCCATC
CGCCTGGTGTCCGGCTTCCTGCCCATCGTGTGGGACGACCTGCGCTCCCTGTGCCTGTTCTCGTACCACCGCCTGCGCGACTTCC
TCCTGCTGGCGGCCCGCGTCGTGGAGCTGCTGGGCCGGTCCTCCCTGCGGGGCCTGCAGCGCGGCTGGGAGGTGCTCAAGTACCT
GGGCTCGCTGGTGCAGTACTGGGGCCTGGAGCTGAAGAAGTCCGCCATCTCCCTGTTCGACACCCTCGCCATCGCCGTGGCGGAG
GGCACCGACCGCATCATCGAACTCATCCAGGGGTTCTGCCGCGCCATCCGCAACATCCCCACCCGCATCCGCCAGGGCTTCGAGG
CCTCGCTCCTGTAGTAAGaattcggtaaccgggacccggatcc
>CH848.3.d1120.10.21.optBF
gtcgacaagaaATGCGCGTGACGGGCATCCTCAAGAACTACCCGCAGTGGTGGATCTGGGGCATCCTGGGCTTCTGGATGCTCAT
GATCTGCAACGGCGAGGAGAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATGTGCTCGAACGCCATCGTGAAGAACTCC
ACGACCGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACAAGACGTCGAACACCTCGGAGTACAGGCTGATCAACTGCAACACCTCCGCGGTCACGCA
```

Figure 3 continued

```
GGCGTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACACGCCCGTGCAGATCGTGTGCACCCGCCCGAACAACAACACGCGCAAGTCCGTCCGGATCGGCCCTGGCCAGACCTTCTAC
GCCACCGGCGACATCATCGGCGACCCGCGGCAGGCCCACTGCAACATCAGCGAGAAGAAGTGGAACGAGACCCTGCAGAAGGTGG
GCATCGAGCTGCAGAAGCACTTCCCCAACAAGACCATCAAGTACAACCAGTCGGCCGGCGGCGACATGGAGATCACCACGCACTC
CTTCAACTGCGGTGGCGAGTTCTTCTACTGCAACACGGCCAAGCTGTTCAACTCGACGTACAACGGCACCTACATCTCCACGAAC
TCCACGGACTCGACCTCGAACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCATCAACAACGA
CTCGAACGAGACGGAGACCTTCAGGCCAGCGGGAGGCGACATGCGCGACAACTGGCGCTCCGAGCTGTACAAGTACAAGGTGGTG
GAGGTGCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGACCGACATCTGGGACAACATGACCTGGATGCAGTG
GGAGCGCGAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCTCGATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGCGCGGGATCGAGGAGGAGGGCGGCGAGCAGGACAAGGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCATCGCCGTG
GCGGAGGGCACCGACCGCATCATCGAAGCGATCCAGGGGTTCTGCCGCGCCATCCGCAACATCCCCACCCGCATCCGCCAGGGCT
TCGAGGCCTCGCTCCTGTAGTAAGaattcggttacccgggacccggatcc
>CH848.3.d1120.10.24.optBF
gtcgacaagaaATGCGCGTGATGGGCATCCTCAAGAACTACCCGCGCTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTCCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGACGGCCACGGTGAACAAGTCC
ACGGTGGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACGCCCGTGGAGATCGTGTGCACCCGCCCGAACAACAACACGCGCAAGTCCGTCCGGATCGGCCCTGGCCAGACCTTCTAC
GCCACCGGCGGGATCGTCGGCGACATCCGGCAGGCCCACTGCAACATCAGCAAGGGCCTCTGGAACGACACCCTGCAGAAGGTGG
GCATCGAGCTGCAGAAGCACTTCCCCAACAAGACCATCAAGTACAACCAGTCGGCCGGCGGCGACATGGAGATCACCACGCACTC
CTTCAACTGCGGTGGCGAGTTCTTCTACTGCAACACGAGCAACCTGTTCAACGGCACGTACAACGGCACCTACATCTCCACGAAC
TCGTCCGCGAACTCGACCTCGTACATCACGCTCCAGTGCCGCATCAAGCAGATCATCAACATGTGGCAGGGGGTGGGCCGCGCTA
TGTACGCACCGCCCATCGCCGGCAACATCACCTGCCGGTCCAACATCACCGGCCTCCTGCTGACCCGCGACGGCGGCACGACCAA
CAACTCGAACGAGACGGAGACCTTCAGGCCAGCGGGAGGCGACATGCGCGACAACTGGCGCTCCGAGCTGTACAAGTACAAGGTG
GTGGAGATCCAGCCCCTGGGCATCGCACCCACCGGGGCCAAGAGGCGGGTCGTGGAGCGCGAGAAGCGCGGCGGGCCTCGGCG
CCCTGTTCCTGGGCTTCCTGGGCGCTGCGGGCTCCACATGGGTGCCGCGTCCATCACCCTGACCGTGCAGGCCCGCCAGCTGCT
CTCCGGCATCGTGCAGCAGCAGTCCAACCTCCTGAGGGCCATCGAGGCCCAGCAGCACATGCTGCAGCTGACCGTGTGGGGCATC
AAGCAGCTGCAGGCCAGGGTGCTCGCGCTCGAGCGCTACCTGAAGGACCAGCAGCTGCTCGGCATGTGGGGCTGCTCCGGCAAGC
TGATCTGCACGACCAACGTGCCCTGGAACACGTCCTGGTCCAACAAGTCGGAGACCGACATCTGGGACAACATGACCTGGATGCA
GTGGGAGCGCGAGATCTCCAACTACACCGAGACCATCTACAAGCTCCTCGAGGACTCCCAGAACCAGCAGGAGCGGAACGAGCAG
GATCTGCTCGCGCTGGACTCGTGGAACTCCCTGTGGAACTGGTTCTCGATCACCAAGTGGCTGTGGTACATCAAGATCTTCATCA
TGATCGTCGGCGGCCTGATCGGCCTGCGCATCGTGTTCGCCGTGCTGTCGATCGTGAACCGCGTGCGCCAGGGCTACTCCCCGCT
GTCCCTGCAAACGCTGACCCCCAACCCCCGGGAGCCGGACAGGCTGCGCGGGATCGAGGAGGAGGGCGGCGAGCAGGACCGCGAC
CGCTCCATCCGCCTGGTGTCCGGCTTCCTGCCCATCGTGTGGGACGACCTGCGCTCCCTGTGCCTGTTCTCGTACCACCGCCTGC
GCGACTTCCTCCTGCTGGCGGCCCGCGTCGTGGAGCTGCTGGGCCGGTCCTCCCTGCGGGGCCTGCAGCGCGGCTGGGAGGTGCT
CAAGTACCTGGGCTCGCTGGTGCAGTACTGGGGCCTGGAGCTGAAGAAGTCCGCCATCTCCCTGTTCGACACCCTCGCCATCGCC
```

Figure 3 continued

GTGGCGGAGGGCACCGACCGCATCATCGAACTCATCCAGGGGTTCTGCCGCGCCATCCGCAACATCCCCACCCGCATCCGCCAGG
GCTTCGAGGCCTCGCTCCTGTAGTAAGaattcggtgaccgggtcccggatcc
>CH848.3.d1120.10.32.optBF
gtcgacaagaaATGCGCGTGACGGGCATCCTCAAGAACTACCCGCGCTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCGTCCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTGGAGAACGGC
ACGGTGGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACGAGACGTCGAACACCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGGCATCGTCATCCGGTCCGAGAACCTCACGAACAACGCGAAGATCATCATCGTGCAGCT
GAACACGTCCGTGGAGATCGTGTGCACCCGCCCGAACAACAACACGCGCAAGTCCGTCCGGATCGGCCCTGGCCAGACCTTCTAC
GCCACCGGCGACATCATCGGCGACCCGCGGCAGGCCCACTGCAACATCAGCAAGGAGAAGTGGAACGACACCCTGCAGAAGGTGG
GCAAGGAGCTGCAGAAGCACTTCCCCAACAAGACCATCCGCTACAACCAGTCGGCCGGCGGCGACATGGAGATCACCACGCACTC
CTTCAACTGCGGTGGCGAGTTCTTCTACTGCAACACGGCGAAGCTGTTCAACAGCACGTACAACGGCACCTACATCTCCACGAAC
TCGACGAACTCGACCTCGAACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCGACGACCAACAA
CTCGAACGAGACGGAGACCTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGACCGACATCTGGGACAACATGACCTGGATGCAGTG
GGAGCGCGAGATCTCCAACTACACCGGGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGCGCGGGATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCGTCGCCGTG
GCGGAGGGCACCGACCGCATCATCGAAGTCATCCAGGGGTTCTGCCGCGCCATCCGCAACATCCCCCGGCGCATCCGCCAGGGCT
TCGAGGCCTCGCTCCTGTAGTAAGaattcggtgaccaggacccggatcc
>CH848.3.d1120.10.41.optBF
gtcgacaagaaATGCGCGTGATGGGCATCCAGAAGAACTACCCGCGCTGGTGGATCTGGGGCATCCTGGGCTTCTGGATGCTCAT
GATCTGCAACGGCGAGGGCAAGCTCTGGGTGACGGTCTACTACGGCGTGCCGGTGTGGAAGGAGGCCAAGACGACCCTGTTCTGC
GCGTCGGACGCCCGCGCCTACGAGAAGGAGGTGCACAACGTGTGGGCGACCCACGCCTGCGTGCCCACGGACCCCAGCCCGCAGG
AGCTCGTCCTGGGCAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGAAGAACTCG
ACCACGGAGGAGATGAAGAACTGCTCCTTCAACACGACGACGGAGATCCGCGACAAGGAGAAGAAGGAGCACGCCCTGTTCTACC
GCCCGGACATCGTGCCGCTGAACAACGAGACGGGCAACACCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCAGCT
GAACACGTCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCAAGCAGGCCCACTGCAACATCAGCGAGGAGAAGTGGAACGACACCCTGCAGAAGGTGG
GCATCGAGCTGCAGAAGCACTTCCCCAACAAGACCATCAAGTACAACCAGTCGGCCGGCGGCGACATGGAGATCACCACGCACTC
CTTCAACTGCGGTGGCGAGTTCTTCTACTGCAACACGTCGAAGCTGTTCAACAGCACGTACAACGGCACCTACATCTCCACGAAC
TCGACGAACTCGACCTCGTACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCATCAACAACGA
CTCGAACGAGACGGAGACCTTCAGGCCAGCGGGAGGCGACATGCGCGACAACTGGCGCTCCGAGCTGTACAAGTACAAGGTGGTG
GAGATCCAGCCCCTGGGCATCGCACCCACCGGGGCCAAGAGGCGGGTCGTGGAGCGCGAGAAGCGCGGCGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG

Figure 3 continued

```
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGATGGACATCTGGGACAACATGACCTGGATGCAGTG
GGAGCGCGAGATCTCCAACTACACCGGGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCGGACAGGCTGCGCGGGATCGAGGAGGAGGGCGGCGAGCAGGACCGCGACCGC
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGGTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCGTCGCCGTG
GCGGAGGGCACCGACCGCATCATCGAAGTCATCCAGGGGTTCTGCCGCGCCATCCGCAACATCCCCCGGCGCATCCGCCAGGGCT
TCGAGGCCTCGCTCCTGTAGTAAGaattcggtgaccaggtcccggatcc
>CH848.3.d1305.10.13.optBF
gtcgacaagaaATGCGCGTGACGGGCATCCTCAAGAACTACCCGCGCTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCCGGGCCTACGAGAAGGAGGTGCACAACGTGTGGGCGACCCACGCCTGCGTGCCCACGGACCCCAGCCCGCAGG
AGCTCGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGATCGCCACGGCGAACGGCTCG
ACGGTGGAGGAGATGAAGAACTGCTCCTTCAACACGACGACGGAGATCCGCGACAAGGAGAAGAAGGAGTACGCCCTGTTCTACC
GCCCGGACATCGTGCCGCTGAACAACAAGACGTCGAACATCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACAACGAG
ACCTTCAACGGGACCGGCCCGTGCAGCAACGTGTCCACCGTGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACACGCCGGTGGAGATCGTGTGCACCCGCCCGAACAACAACACGCGCAAGTCCGTCCGGATCGGCCCTGGCCAGACCTTCTAC
GCCACCGGCGACATCATCGGCAACCCGCGGCAGGCCCACTGCAACATCAGCAAGGAGCGGTGGAACGACACCCTGCAGAAGGTGG
GCAAGGAGCTGCAGAAGCACTTCCCCAACAAGACCATCCGCTACAACCAGTCGGCCGGCGGCGACATGGAGATCACCACGCACTC
CTTCAACTGCGGTGGCGAGTTCTTCTACTGCAACACGTCGAACCTGTTCAACAGCACGTACAACGACACCTACATCTCCACGAAC
TCGTCCGCGAACAACTCCTCGACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCACGGACTC
GAACGAGACGGAGACCTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGAGGCGGGTCGTGGAGCGCGAGAAGCGCGCGGTGGGCCTCGGCGCCCTGT
TCCTGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGATCT
GCACGACCAACGTGCCCTGGAACACGTCCTGGTCCAACAAGTCGGAGACCGACATCTGGGACAACATGACCTGGATGCAGTGGGA
GCGCGAGATCTCCAACTACACCGGGACCATCTACAAGCTCCTCGAGGACTCCCAGAACCAGCAGGAGCGGAACGAGCAGGATCTG
CTCGCGCTGGACTCGTGGAACAACCTGTGGTCGTGGTTCTCCATCACCAAGTGGCTGTGGTACATCAAGATCTTCATCATGATCG
TCGGCGGCCTGATCGGCCTGCGCATCGTGTTCGCCGTGCTGTCGATCGTGAACCGCGTGCGCCAGGGCTACTCCCCGCTGTCCCT
GCAAACGCTGACCCCCAACCCCCGGGAGCTCGACAGGCTGCGCGGGATCGAGGAGGAGGGCGGCGAGCAGGACCGCGACAAGTCC
ATCCGCCTGGTGGACGGCTTCCTGCCCATCGTGTGGGACGACCTGCGCTCCCTGTGCCTGTTCTCGTACCACCGCCTGCGCGACT
TCCTCCTGCTGGCGGCCCGCGTCGTGGAGCTGCTGGGCCGGTCCTCCCTGCGGGGCCTGCAGCGCGGCTGGGAGGTGCTCAAGTA
CCTGGGCTCGCTGGTGCAGTACTGGGGCCTGGAGCTGAAGAAGTCCGCCATCTCCCTGTTCGACACCCTCGCCGTCGCCGTGGCG
GAGGGCACCGACCGCATCATCGAAGTCATCCAGGGGTTCTGCCGCGCCATCCGCAACATCCCCCGGCGCATCCGCCAGGGCTTCG
AGGCCTCGCTCCTGTAGTAAGaattcggtgaccgggacctggatcc
>CH848.3.d1305.10.21.optBF
gtcgacaagaaATGCGCGTGACGGGCATCCTCAAGAACTACCCGCGCTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCAGCCCGCAGG
AGCTCGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCACGGTGGAGAACTCG
ACGACGGAGGAGATGAAGAACTGCTCCTTCAACACGACGACGGAGATCCGCGACAAGGAGAAGAAGGAGCACGCCCTGTTCTACC
GCCCGGACATCGTGCCGCTGAACAACGAGACGGGCAACGTCCGGTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAAGGTGTCCACCGTGCAGTGCACGCACGGCATCCGGCCCGTGGTGTCCACGCAGCTGC
TCCTGAACGGGTCGCTGGCGGAGAAGGGGATCGTCATCCGGTCCGAGAACCTCACGAACAACGCGAAGATCATCATCGTGCAGCT
GAACACGTCGGTGGAGATCGTGTGCACCCGCCCGAACAACAACACGCGCAAGTCCGTCCGGATCGGCCCTGGCCAGACCTTCTAC
```

Figure 3 continued

```
GCCACCGGCGACATCATCGGCAACATCCGGCAGGCCCACTGCAACATCAGCGAGTCGAAGTGGAACGACACCCTGCAGAAGGTGG
GCATCGAGCTGCAGAAGCACTTCCCCAACAAGACCATCAAGTACAACCAGTCGGCCGGCGGCGACATGGAGATCACCACGCACTC
CTTCAACTGCGGTGGCGAGTTCTTCTACTGCAACACGGCGAAGCTGTTCAACAGCACGTACAACGGCACCTACATCTCCACGAAC
TCGACGAACTCGACGTCCAAGAACATCACGCTCCAGTGCCGCATCAAGCAGATCATCAACATGTGGCAGGGGGTGGGCCGCGCTA
TGTACGCACCGCCCATCGCCGGCAACATCACCTGCCGCTCCAACATCACCGGCCTCCTGCTGACCCGCGACGGCGGCACGACGAA
CAACTCGAACGAGACGGAGACCTTCAGGCCAGCGGGAGGCGACATGCGCGACAACTGGCGCTCCGAGCTGTACAAGTACAAGGTG
GTGGAGGTCCAGCCCCTGGGCATCGCACCCACCGGGGCCAAGAGGCGGGTCGTGGAGCGCGAGAAGCGCGCGGCCGGCCTCGGCG
CCCTGTTCCTGGGCTTCCTGGGCGCTGCGGGCTCCACCATGGGTGCCGCGTCCATCACCCTGACCGTGCAGGCCCGCCAGCTGCT
CTCCGGCATCGTGCAGCAGCAGTCCAACCTCCTGAGGGCCATCGAGGCCCAGCAGCACATGCTGCAGCTGACCGTGTGGGGCATC
AAGCAGCTGCAGGCCAGGGTGCTCGCGCTCGAGCGCTACCTGAAGGACCAGCAGCTGCTCGGCATCTGGGGCTGCTCCGGCAAGC
TGATCTGCACGACCAACGTGCCCTGGAACACGTCCTGGTCCAACAAGTCGGAGACCGACATCTGGGGCAACATGACCTGGATGCA
GTGGGAGCGCGAGATCTCCAACTACACCGAGACCATCTACAAGCTCCTCGAGGACTCCCAGAACCAGCAGGAGCGGAACGAGCAG
GATCTGCTCGCGCTGGACTCGTGGAACTCGCTGTGGTCGTGGTTCAACATCACCAAGTGGCTGTGGTACATCAAGATCTTCATCA
TGATCGTCGGCGGCCTGATCGGCCTGCGCATCGTGTTCGCCGTGCTGTCGATCGTGAACCGCGTGCGCCAGGGCTACTCCCCGCT
GTCCCTGCAAACGCTGACCCCCAACCCCCGGGAGCCCGACAGGCTGCGCGGGATCGAGGAGGAGGGCGGCGAGCAGGACCGCGAC
AAGTCCATCCGCCTGGTGAACGGCTTCCTGCCCATCGTGTGGGACGACCTGCGCTCCCTGTGCCTGTTCTCGTACCACCGCCTGC
GCGACTTCCTCCTGCTGGCGGCCCGCGTCGTGGAGCTGCTGGGCCGGTCCTGCCTGCGGGGCCTGCAGCGCGGCTGGGAGGTGCT
CAAGTACCTGGGCTCGCTGGTGCAGTACTGGGGCCTGGAGCTGAAGAAGTCCGCCATCTCCCTGTTCGACACCCTCGCCATCACG
GTGGCGGAGGGCACCGACCGCATCATCGAACTCATCCAGGGGTTCTGCCGCGCCATCCGCAACATCCCCCGGCGCATCCGCCAGG
GCTTCGAGGCCTCGCTCCTGTAGTAAGaattcggtgaccgggtcctggatcc
>CH848.3.d1305.10.30.optBF
gtcgacaagaaATGCGCGTGACGGGCATCCTCAAGAACTACCCGCAGTGGTGGATCTGGGGCATCCTGGGCTTCTGGATGCTCAT
GACGTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGACCGCCACGGTGAACAACTCG
ACGGTGGACGAGATGAAGAACTGCTCCTTCAACGCGACGACGGAGATCCGCGACAAGAAGAAGAAGGAGTACGCCCTGTTCTACC
GCTCCGACGTCGTGCCGCTGGACGAGACGAACAACACGTCGGAGTACAGGCTGATCAACTGCAACACCTCCGCGGTCACGCAGGC
GTGCCCCAAGGTCACGTTCGAGCCCATCCCCATCCACTACTGCGCCCCGCCGGCTACGCCATCCTGAAGTGCAACGACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGCA
CACGCCGGTGGAGATCGTGTGCACCCGCCCGGGGCACAACACGCGCAAGTCCGTCCGGATCGGCCCTGGCCAGACCTTCTACGCC
ACCGGCGACATCATCGGCGACATCCGGCAGGCCCACTGCAACATCAACGAGTCGGAGTGGAACGACACCCTGCAGAAGGTGGGCA
AGGAGCTGCAGAAGCACTTCCCCAACAAGACCATCAAGTACGAGCAGTCGGCCGGCGGCGACATGGAGATCACCACGCACTCCTT
CAACTGCGGTGGCGAGTTCTTCTACTGCAACACGGCGGAGCTGTTCAACGGCACGTACAACGGCACCGACATCTCCACGAACTCG
TCGGCGAACTCCACGTCCACGATCACGCTCCAGTGCCGCATCAAGCAGATCATCAACATGTGGCAGGGGGTGGGCCGCGCTATGT
ACGCACCGCCCATCGCCGGCAACATCACCTGCCGCTCCAACATCACCGGCCTCCTGCTGACCCGCGACGGCGGCATCAACAACGT
CTCGAACGAGACGGAGACCTTCAGGCCAGCGGGAGGCGACATGCGCGACAACTGGCGCTCCGAGCTGTACAAGTACAAGGTGGTG
GAGGTCCAGCCCCTGGGCATCGCACCCACCGGGGCCAAGAGGCGGGTCGTGGAGCGCGAGAAGCGCGCGGCCGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGATGGACATCTGGAACAACATGACCTGGATGCAGTG
GGAGCGCGAGATCTCCAACTACACCGAGACCATCTACATGCTCCTCGAGGACTCCCAGCGGCAGCAGGAGCGGAACGAGAAGGAT
CTGCTCGCGCTGGACTCGTGGAACTCGCTGTGGAACTGGTTCAACATCACCAACTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCCGACAGGCTGCGCGGGATCGAGGAGGAGGGCGGCGAGCAGGACCGCGACCGG
TCCATCCGCCTGGTGTCCGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCACTCCTCCCTGCGGGGCCTGCAGCGCGGCTGGGAGGTGCTCAA
GTACCTGGGCTCGCTGGTGCAGTACTGGGGCCTGGAGCTGAAGCGGTCCGCCATCTCCCTGTTCGACACCCTCGCCATCGCCGTG
GCGGAGGGCACCGACCGCATCATCGAACTCATCCAGGGGTTCTGCCGCGCCATCCGCAACATCCCCACCCGCATCCGCCAGGGCT
TCGAGGCCTCGCTCCTGTAGTAAGaattcggtcaccgggtcccggatcc
>CH848.3.d1305.10.35.optBF
gtcgacaagaaATGCGCGTGACGGGCATCCGGAAGAACTGCCCGCAGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
```

Figure 3 continued

```
GCGTCGGACGCCAAGGCCTACGTGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGACCGCCACGGTGAACAACTCG
AAGTTCGAGGAGATGAAGAACTGCTCCTTCAACACCACGACGGAGATCCGCGACAAGGAGAAGAAGGAGTACGCCCTGTTCTACC
GCCCCGACATCGTGCCGCTGGACAACGAGACGTCCAACATCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAACGTGTCCACCGTGCAGTGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCACCT
GCACACGCCGGTGGAGATCGTGTGCACCCGCCCGAACAACAACACGCGCAAGTCCGTCCGGATCGGCCCTGGCCAGACCTTCTAC
GCCACCGGCGACATCATCGGCAACCCGCGGCAGGCCCACTGCAACATCTCGAAGGAGCGGTGGAACGACACCCTGCAGAAGGTGG
GCAAGGAGCTGCAGAAGCACTTCCCCAACAAGACCATCAAGTACAACCAGTCGGCCGGCGGCGACATGGAGATCACCACGCACTC
CTTCAACTGCGGTGGCGAGTTCTTCTACTGCAACACGTCCAACCTGTTCAACTCGACGTACAACGACACCTACATCTCCACGAAC
TCGACCAACTCCACGTCCTACATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCATCAACAAGGA
CTCGAACGAGACGGAGACCTTCAGGCCAGCGGGAGGCGACATGCGCGACAACTGGCGCTCCGAGCTGTACAAGTACAAGGTGGTG
GAGGTCCAGCCCCTGGGCATCGCACCCACCGGGGCCAAGAGGCGGGTCGTGGAGCGCGAGAAGCGCGCGGCCGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGACGGACATCTGGGACAACATGACCTGGATGCAGTG
GGAGCGCGAGATCTCCAACTACACCGGGACCATCTACAAGCTCCTCGAGGACTCCCAGAACCAGCAGGAGCGGAACGAGCAGGAT
CTGCTCGCGCTGGACTCGTGGAACTCGCTGTGGAACTGGTTCTCCATCACCAAGTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCCGACAGGCTGCGCGGGATCGAGGAGGAGGGCGGCGAGCAGGACCGCGACAAG
TCCATCCGCCTGGTGAACGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCGCTCCTCCCTGCGGGGCCTGCAGCGCGGCTGGGAGGTGCTCAA
GTACCTGGGCTCGCTGGTGCAGTACTGGGGCCTGGAGCTGAAGAAGTCCGCCATCTCCCTGTTCGACACCCTCGCCGTGGCCGTG
GCGGAGGGCACCGACCGCATCATCGAAGTCATCCAGGGGTTCTGCCGCGCCATCCGCAACATCCCCAGGCGCATCCGCCAGGGCT
TCGAGGCCTCGCTCCTGTAGTAAGaattcggtcaccaggacccggatcc
>CH848.3.d1432.5.18.optBF
gtcgacaagaaATGCGCGTGACGGGCATCCTGAAGAACTGCCCGCTGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTGAAGAACTCC
ACCACCGAGGAGATGAGCAACGCCACCGTCAAGAACAGCACCACGGAGGAGATGTCCAACGCCACGGTGAAGAACTCGACGACAG
AGGAGATGAAGAACTGCTCCTTCAACACCACGACGGAGATCCGCGACAAGGAGAAGAAGGAGTACGCCCTGTTCTACCGCCCCGA
CGTCGTGCCGCTGGACGAGACGAACAACACCTCGAAGTACAGGCTGATCAACTGCAACACCTCCGCGGTCACGCAGGCGTGCCCC
AAGGTCACGTTCGAGCCCATCCCCATCCACTACTGCGCCCCCGCCGGCTACGCCATCCTGAAGTGCAACGACGAGACCTTCAACG
GGACCGGCCCGTGCAGCAAGGTGTCCACCGTGCAGTGCACGCACGGCATCCGGCCCGTGGTGTCCACGCAGCTGCTCCTGAACGG
GTCGCTGGCGGAGAAGGAGATCGTCATCCGGTCCGAGAACCTCACGAACAACGCGAAGATCATCATCGTGCACCTGCACACGCCG
GTGGAGATCGTGTGCACCCGCCCGTACAACAACACGCGCAAGTCCGTCCGGATCGGCCCTGGCCAGACCTTCTACGCCACCGGCG
ACATCATCGGCGACCCGCGGCAGGCCCACTGCAACATCTCGAAGGAGATCTGGAACAAGACCCTGCAGGAGGTGGGCAAGGAGCT
GCAGAAGCACTTCCCCAACAAGACCATCCGGTACAACCAGTCGGCCGGCGGCGACATGGAGATCACCACGCACTCCTTCAACTGC
GGTGGCGAGTTCTTCTACTGCAACACGTCCAACCTGTTCAACTCGACGTACAACGACACCTACATCTCCCCGAACTCGACCAACT
CCACGTCCACCATCACGCTCCAGTGCCGCATCAAGCAGATCATCAACATGTGGCAGGGGTGGGCCGCGCTATGTACGCACCGCC
CATCGCCGGCAACATCACCTGCAAGTCCAACATCACCGGCCTCCTGCTGACCCGCGACGGCGGCATCAACAACGTGTCGAACGAG
ACGGAGACCTTCAGGCCAGCGGGAGGCGACATGCGCGACAACTGGCGCTCCGAGCTGTACAAGTACAAGGTGGTGGAGGTCCAGC
CCCTGGGCCTCGCACCCACCGGGGCCAAGAGGCGGGTCGTGGAGCGCGAGAAGCGCGCGGCCGGCCTCGGCGCCCTGTTCCTGGG
CTTCCTGGGCGCTGCGGGCTCCACCATGGGTGCCGCGTCCATCACCCTGACCGTGCAGGCCCGCCAGCTGCTCTCCGGCATCGTG
CAGCAGCAGTCCAACCTCCTGAGGGCCATCGAGGCCCAGCAGCACATGCTGCAGCTGACCGTGTGGGGCATCAAGCAGCTGCAGG
CCAGGGTGCTCGCGCTCGAGCGCTACCTGAAGGACCAGCAGCTGCTCGGCATGTGGGGCTGCTCCGGCAAGCTGATCTGCACGAC
CAACGTGCCCTGGAACACGTCCTGGTCCAACAAGTCGGAGACGGACATCTGGGACAACATGACCTGGATGCAGTGGGAGCGCGAG
ATCTCCAACTACACCGGGACCATCTACAAGCTCCTCGAGGACTCCCAGAACCAGCAGGAGCGGAACGAGCAGGATCTGCTCGCGC
TGGACTCGTGGAACTCGCTGTGGAACTGGTTCTCCATCACCAAGTGGCTGTGGTACATCAAGATCTTCATCATGATCGTCGGCGG
```

Figure 3 continued

```
CCTGATCGGCCTGCGCATCGTGTTCGCCGTGCTGTCGATCGTGAACCGCGTGCGCCAGGGCTACTCCCCGCTGTCCCTGCAAACG
CTGACCCCCAACCCCCGGGAGCCCGACAGGCTGCGCGGGATCGAGGAGGAGGGCGGCGAGCAGGACCGCGACAAGTCCATCCGCC
TGGTGAACGGCTTCCTGCCCATCGTGTGGGACGACCTGCGCTCCCTGTGCCTGTTCTCGTACCACCGCCTGCGCGACTTCCTCCT
GCTGGCGGCCCGCGTCGTGGAGCTGCTGGGCCGCTCCTCCCTGCGGGGCCTGCAGCGCGGCTGGGAGGTGCTCAAGTACCTGGGC
TCGCTGGTGCAGTACTGGGGCCTGGAGCTGAAGAAGTCCGCCATCTCCCTGTTCGACACCCTCGCCGTGGCCGTGGCGGAGGGCA
CCGACCGCATCATCGAAGTCATCCAGGGGTTCTGCCGCGCCATCCGCAACATCCCCAGGCGCATCCGCCAGGGCTTCGAGGCCTC
GCTCCTGTAGTAAGaattcggtcaccaggtcccggatcc
>CH848.3.d1432.5.27.optBF
gtcgacaagaaATGCGCGTGACGGGCATCCTGAAGAACTACCCGCGCTGGTGGATCTGGGGCATCCTGGGCTTCTGGATGCTCAT
GAACTGCAACGGCGAGGGCAAGCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCACGGTGAACAACACC
ACCGACTACGACTCCAGGAGCAACGCCAACGTCACCAACATCACCAACACCATCAAGGAGGAGGTGAAGAACTGCTCCTTCAAGA
CCACGACGGAGATCCGCGACAAGGAGAAGAAGGAGCACGCCCTGTTCTACCGCCCCGACATCGTGCCGCTGAACTCGGAGACGGG
GAACACCTCGGAGTACAGGCTGATCAACTGCAACACCTCCGCGGCTCACGCAGGCGTGCCCCAAGGTCACGTTCGAGCCCATCCCC
ATCCACTACTGCGCCCCCGCCGGCTACGCCATCCTGAAGTGCAACGACGAGACCTTCAACGGGACCGGCCCGTGCAGCAAGGTGT
CCACCGTGCAGTGCACGCACGGCATCCGGCCCGTGGTGTCCACGCAGCTGCTCCTGAACGGGTCGCTGGCGGAGAAGGGGATCGT
CATCCGGTCCGAGAACCTCACGAACAACGCGAAGATCATCATCGTGCAGCTGAACACGTCGGTGGAGATCGTGTGCACCCGCCCG
GGCAACAACACGCGCAAGTCCATGCGGATCGGCCCTGGCCAGACCTTCTACGCCACCGGCGACATCATCGGCGACATCCGGCAGG
CCCACTGCAACATCTCGGAGTCGAAGTGGAACGACACCCTGCAGAAGGTGGGCATCGAGCTGCAGAAGCACTTCCCCAACAAGAC
CATCAAGTACAACCAGTCGGCCGGCGGCGACATGGAGATCACCACGCACTCCTTCAACTGCGGTGGCGAGTTCTTCTACTGCAAC
ACGGCCAAGCTGTTCAACTCGACGTACAACGGCACCTACATCTCCGACGAACTCGTCCGCCAACTCCACGTCCAAGAACATCACGC
TCCAGTGCCGCATCAAGCAGATCATCAACATGTGGCAGGGGGTGGGCCGCGCTATGTACGCACCGCCCATCGCCGGCAACATCAC
CTGCCGGTCCAACATCACCGGCCTCCTGCTGACCCGCGACGGCGGCATCCACAACGACTCGAACGAGACGGAGACCTTCAGGCCA
GCGGGAGGCGACATGCGCGACAACTGGCGCTCCGAGCTGTACAAGTACAAGGTGGTGGAGATCCAGCCCCTGGGCATCGCACCCA
CCGGGGCCAAGAGGCGGGTCGTGGGGCGCGAGAAGCGCGCGGCCGGCCTCGGCGCCCTGTTCCTGGGCTTCCTGGGCGCTGCGGG
CTCCACCATGGGTGCCGCGTCCATCACCCTGACCGTGCAGGCCCGCCAGCTGCTCTCCGGCATCGTGCAGCAGCAGTCCAACCTC
CTGAGGGCCATCGAGGCCCAGCAGCACATGCTGCAGCTGACCGTGTGGGGCATCAAGCAGCTGCAGGCCAGGGTGCTCGCGCTCG
AGCGCTACCTGAAGGACCAGCAGCTGCTCGGCATCTGGGGCTGCTCCGGCAAGCTGATCTGCACGACCAACGTGCCCTGGAACAC
GTCCTGGTCCAACAAGTCGGAGACGGACATCTGGGAGAACATGACCTGGATGCAGTGGGAGCGCGAGATCTCCAACTACACCGAG
ACCATCTACAAGCTCCTCGAGGACTCCCAGAACCAGCAGGAGCGGAACGAGCAGGATCTGCTCGCGCTGGACTCGTGGAACTCGC
TGTGGAACTGGTTCTCCATCACCAAGTGGCTGTGGTACATCAAGATCTTCATCATGATCGTCGGCGGCCTGATCGGCCTGCGCAT
CGTGTTCGCCGTGCTGTCGATCGTGAACCGCGTGCGCCAGGGCTACTCCCCGCTGTCCCTGCAAACGCTGACCCCCAACCCCCGG
GAGCCCGACAGGCTGCGCGGGATCGAGGAGGAGGGCGGCGAGCAGGACCGCGACAAGTCCATCCGCCTGGTGAACGGCTTCCTGC
CCATCGTGTGGGACGACCTGCGCTCCCTGTGCCTGTTCTCGTACCACCGCCTGCGCGACTTCCTCCTGCTGGCGGCCCGCGTCGT
GGAGCTGCTGGGCCGCTCCTCCCTGCGGGGCCTGCAGCGCGGCTGGGAGGTGCTCAAGTACCTGGGCTCGCTGGTGCAGTACTGG
GGCCTGGAGCTGAAGAAGTCCGCCATCTCCCTGTTCGACACCCTCGCCATCGCCGTGGCCGGAGGGCACCGACCGCATCATCGAAG
CCATCCAGGGGTTCTGCCGCGCCATCCGCAACATCCCCACCCGCATCCGCCAGGGCTTCGAGGCCTCGCTCCTGTAGTAAGaatt
cggtcaccgggacctggatcc
>CH848.3.d1432.5.41.optBF
gtcgacaagaaATGCGCGTGACGGGCATCCTGCGGAACTACCCGCAGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCG
ACCACGGAGGAGATGTCCACCGCCCTCGTGAAGAACTCCACGACCGAGGCGATGAAGAACTGCTCCTTCAACACCACGACGGAGA
TCCGCGACAAGGAGAAGAAGGAGTACGCCCTGTTCTACCGCCCCGACATCGTGCCGCTGAACAACGAGACGGGGAACATCTCCGA
GTACAGGCTGATCAACTGCAACACCTCCGCGGTCACGCAGGCGTGCCCCAAGGTCACGTTCGAGCCCATCCCCATCCACTACTGC
GCCCCCGCCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGAAGGAGGAGATCGTCATCCGGTCCGA
GAACCTCACGAACAACGCGAAGATCATCATCGTGCACCTGCACACGCGGTGGAGATCGTGTGCACCCGCCCGAACAACAACACG
CGCAAGTCCGTGCGGATCGGCCCTGGCCAGACCTTCTACGCCACCGGCGACATCATCGGCGACCCGCGGAAGGCCCACTGCAACA
TCTCGGAGAAGGACTGGAACAAGACCCTGCAGGAGGTGGGCAAGGAGCTGCAGAAGCACTTCCCCAACAAGACCATCCGGTACAA
CCAGTCGGCCGGCGGCGACATGGAGATCACCACGCACTCCTTCAACTGCGGTGGCGAGTTCTTCTACTGCAACACGTCGAAGCTG
```

Figure 3 continued

```
TTCAACTCGACGTACAACGACACCTACATCTCCACGAACTCGTCCGCCAACAACTCGTCCACGATCACGCTCCAGTGCCGCATCA
AGCAGATCATCAACATGTGGCAGGGGGTGGGCCGCGCTATGTACGCACCGCCCATCGCCGGCAACATCACCTGCAAGTCCAACAT
CACCGGCCTCCTGCTGACCCGCGACGGCGGCCCGGACTCGAACGAGACGGAGACCTTCAGGCCAGCGGGAGGCGACATGCGCGAC
AACTGGCGCTCCGAGCTGTACAAGTACAAGGTGGTGGAGGTCCAGCCCCTGGGCATCGCACCCACCGGGGCCAAGAGGCGGGTCG
TGGAGCGCGAGAAGCGCGCGGCCGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCCCAG
CAGCACATGCTGCAGCTGACCGTGTGGGGCATCAAGCAGCTGCAGGCCAGGGTGCTCGCGCTCGAGCGCTACCTGAAGGACCAGC
AGCTGCTCGGCATCTGGGGCTGCTCCGGCAAGCTGATCTGCACGACCAACGTGCCCTGGAACACGTCCTGGTCCAACAAGTCGGA
GACGGACATCTGGGGGAACATGACCTGGATGCAGTGGGAGCGCGAGATCTCCAACTACACCGAGACCATCTACAAGCTCCTCGAG
GACTCCCAGAACCAGCAGGAGCGGAACGAGCAGAACCTGCTCGCGCTGGACTCGTGGAACTCGCTGTGGAACTGGTTCTCCATCA
CCAAGTGGCTGTGGTACATCAAGATCTTCATCATGATCGTCGGCGGCCTGATCGGCCTGCGCATCGTGTTCGCCGTGCTGTCGAT
CGTGAACCGCGTGCGCCAGGGCTACTCCCCGCTGTCCCTGCAAACGCTGACCCCCAACCCCCGGGAGCCCGACAGGCTGCGCGGG
ATCGAGGAGGAGGGCGGCGAGCAGGACCGCGACAAGTCCATCCGCCTGGTGAACGGCTTCCTGCCCATCGTGTGGGACGACCTGC
GCTCCCTGTGCCTGTTCTCGTACCACCGCCTGCGCGACTTCCTCCTGCTGGCGGCCCGCGTCGTGGAGCTGCTGGGCCGCTCCTC
CCTGCGGGCCTGCAGCGCGGCTGGGAGGTGCTCAAGTACCTGGGCTCGCTGGTGCAGTACTGGGGCCTGGAGCTGAAGAAGTCC
GCCATCTCCCTGCTGGACACCATCGCCATCGCCGTGGCGGAGGGCACCGACCGCATCATCGAAGCCATCCAGGGGTTCTGCCGCG
CCATCCGCAACATCCCCAGGCGCATCCGCCAGGGCTTCGAGGCCTCGCTCCTGTAGTAAGaattcggtcaccgggtcctggatcc
>CH848.3.d1432.5.50.optBF
gtcgacaagaaATGCGCGTGACGGGCATCCTGAAGAACTACCCGCAGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGACCGCCACGGTGAACAACTCC
ACGGTGGACGAGATGAAGAACTGCTCCTTCAACGCCACGACGGAGATCCGCGACAAGAAGAAGAAGGAGTACGCCCTGTTCTACC
GCTCGGACGTCGTGCCGCTGGACGAGACGAACAACACGTCCGAGTACAGGCTGATCAACTGCAACACCTCCGCGGTCACGCAGGC
GTGCCCCAAGGTCACGTTCGAGCCCATCCCCATCTACTGCGCCCCCGCCGGCTACGCCATCCTGAAGTGCAACGACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGATCATCATCGTGCACCTGCA
CACGCCGGTGGAGATCGTGTGCACCCGCCCGGGCCACAACACGCGCAAGTCCGTGCGGATCGGCCCTGGCCAGACCTTCTACGCC
ACCGGCGACATCATCGGCGACATCCGGCAGGCCCACTGCAACATCAACGAGTCGAAGTGGAACGAGACCCTGCAGAAGGTGGGCA
ACGAGCTGCAGAAGCACTTCCCCAACAAGACCATCAAGTACGAGCAGGCGGCCGGCGGCGACATGGAGATCACCACGCACTCCTT
CAACTGCGGTGGCGAGTTCTTCTACTGCAACACGGCCAACCTGTTCAACGGCACGTACAACGGGACCGACATCTCCACGAACTCG
TCCGCCAACTCGACGTCCACGATCACGCTCCAGTGCAAGATCAAGCAGATCATCAACATGTGGCAGGGGGTGGGCGCGCTATGT
ACGCACCGCCCATCGCCGGCAACATCACCTGCCGCTCCAACATCACCGGCCTCCTGCTGACCCGCGACGGCGGCCATCAACAACGT
GTCGAACGAGACGGAGACCTTCAGGCCAGCGGGAGGCGACATGCGCGACAACTGGCGCTCCGAGCTGTACAAGTACAAGGTGGTG
GAGGTCCAGCCCCTGGGCATCGCACCCACCGGGGCCAAGAGGCGGGTCGTGGAGCGCGAGAAGCGCGCGGCCGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGATGGACATCTGGAACAACATGACCTGGATGCAGTG
GGAGCGCGAGATCTCCAACTACACCGAGACCATCTACATGCTCCTCGAGGACTCCCAGCAGAGCAGGAACGAGCAGAAAGAC
CTGCTCGCGCTGGACTCGTGGAACTCGCTGTGGAACTGGTTCAACATCACCAACTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCCGACAGGCTGCGCGGGATCGAGGAGGAGGGCGGCGAGCAGGACCGCGACCGG
TCCATCCGCCTGGTGTCGGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCACTCCTCCCTGCGGGGCCTGCAGCGCGGCTGGGAGGTGCTCAA
GTACCTGGGCTCGCTGGTGCAGTACTGGGGCCTGGAGCTGAAGAAGGGCGCCATCTCCCTGTTCGACACCCTCGCCATCACCGTG
GCGGAGGGCACCGACCGCATCATCGAAGTCATCCAGGGGTTCTGCCGCGCCATCCGCAACATCCCCACGCGCATCCGCCAGGGCT
TCGAGGCCTCGCTCCTGTAGTAAGaattcggtaaccgggtcccggatcc
>CH848.3.d1432.5.56.optBF
gtcgacaagaaATGCGCGTGACGGGCATCCTGAAGAACTACCCGCGGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCG
```

Figure 3 continued

```
ACCACCGAGGAGATGTCCAACGCCACGGTGAAGAACTCCACGACGGAGGAGATGAAGAACTGCTCCTTCAACACCACGACGGAGA
TCCGCGACAAGGAGAAGAAGGAGTACGCCCTGTTCTACCGCCCCGACGTCGTGCCGCTGGACGAGACGAACAACACGTCCAAGTA
CAGGCTGATCAACTGCAACACCTCCGCGGTCACGCAGGCGTGCCCCAAGGTCACGTTCGAGCCCATCCCCATCCACTACTGCGCC
CCCGCCGGCTACGCCATCCTGAAGTGCAACGACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGAAGGAGATCGTCATCCGGTCCGAGAA
CCTCACGAACAACGCGAAGATCATCATCGTGCACCTGCACACGCCGGTGGAGATCGTGTGCACCCGCCCGTACAACAACACGCGC
AAGTCCGTGCGGATCGGCCCTGGCCAGACCTTCTACGCCACCGGCGACATCATCGGCGACCCGCGGCAGGCCCACTGCAACATCT
CGAAGGAGATCTGGAACAAGACCCTGCAGGAGGTGGGCAAGGAGCTGCAGAAGCACTTCCCCAACAAGACCATCCGCTACAACCA
GTCCGCCGGCGGCGACATGGAGATCACCACGCACTCCTTCAACTGCGGTGGCGAGTTCTTCTACTGCAACACGGCCAAGCTGTTC
AACTCCACGTACAACGACACCTACAAGTCCACGAACTCGTCCGCCAACAACTCGTCCATCATCACGCTCCAGTGCCGGATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCATCAACAACGTGTCGAACGAGACGGAGACCTTCAGGCCAGCGGGAGGCGACAACTGG
CGCTCCGAGCTGTACAAGTACAAGGTGGTGGAGGTCCAGCCCCTGGGCATCGCACCCACCGGGGCCAAGAGGCGGGTCGTGGAGC
GCGAGAAGCGCGCGGTGGGCCTCGGCGCCCTGTTCCTGGGCTTCCTGGGCGCTGCGGGCTCCACCATGGGTGCCGCGTCCATCAC
CCTGACCGTGCAGGCCCGCCAGCTGCTCTCCGGCATCGTGCAGCAGCAGTCCAACCTCCTGAGGGCCATCGAGGCCCAGCAGCAC
ATGCTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACGACCAACGTGCCCTGGAACACGTCCTGGTCCAACAAGTCGGAGACCGA
CATCTGGGACAACATGACCTGGATGCAGTGGGAGCGCGAGATCTCCAACTACACCGGGACCATCTACAAGCTCCTCGAGGACTCC
CAGAACCAGCAGGAGCGGAACGAGCAAGACCTGCTCGCGCTGGACTCGTGGAACTCGCTGTGGAACTGGTTCTCCATCACCAAGT
GGCTGTGGTACATCAAGATCTTCATCATGATCGTCGGCGGCCTGATCGGCCTGCGCATCGTGTTCGCCGTGCTGTCGATCGTGAA
CCGCGTGCGCCAGGGCTACTCCCCGCTGTCCCTGCAAACGCTGACCCCCAACCCCCGGGAGCCCGACAGGCTGCGCGGGATCGAG
GAGGAGGGCGGCGAGCAGGACCGCGACAAGTCCATCCGCCTGGTGAACGGCTTCCTGCCCATCGTGTGGGACGACCTGCGCTCCC
TGTGCCTGTTCTCGTACCACCGCCTGCGCGACTTCCTCCTGCTGGCGGCCCGCGTCGTGGAGCTGCTGGGCCGGTCCTGCCTGCG
GGGCCTGCAGCGCGGCTGGGAGGTGCTCAAGTACCTGGGCTCGCTGGTGCAGTACTGGGGCCTGGAGCTGAAGAAGTCCGCCATC
TCCCTGTTCGACACCCTCGCCGTGGCCGTGGCGGAGGGCACCGACCGCATCATCGAACTCATCCAGGGGTTCTGCCGCGCCATCC
GCAACATCCCCCGGCGCATCCGCCAGGGCTTCGAGGCCTCGCTCCTGTAGTAAgaattcggtaaccaggacccggatcc
>CH848.3.d1621.4.12.optBF
gtcgacaagaaATGCGCGTGACGGGCATCCTGAAGAACTACCCGCGGTGGTGGATCTGGGGCATCCTGGGCTTCTGGATGCTCAT
GAACTGCAACGGCGAGGGCAAGCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCAGCCCGCAGG
AGCTCTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCACGGTCAACTCCACC
ACCGACTACGACTCCCGGTCCAACGACACCGTGACCAACATCACGAACACGATCAAGGAGGAGGTGAAGAACTGCTCCTTCAAGA
CCACGACGGAGATCCGCGACAAGGAGAAGAAGGAGCACGCCCTGTTCTACCGCCCCGACATCGTGCCGCTGAACTCCGAGACGGG
CAACACGTCCGAGTACAGGCTGATCAACTGCAACACCTCCGCGGTCACGCAGGCGTGCCCCAAGGTCACGTTCGAGCCCATCCCC
ATCCACTACTGCGCCCCCGCCGGCTACGCCATCCTGAAGTGCAACGACGAGACCTTCAACGGGACCGGCCCGTGCAGCAACGTGT
CCACCGTGCAGTGCACGCACGGCATCCGGCCCGTGGTGTCCACGCAGCTGCTCCTGAACGGGTCGCTGGCGAAGGAGGAGATCGT
CATCCGGTCCGAGAACCTCACGAACAACGCGAAGACCATCATCGTGCACCTGCACACGCCGGTGGAGATCGTGTGCACCCGCCCG
GGCAACAACACGCGCAAGTCCATGCGGATCGGCCCTGGCCAGACCTTCTACGCCACCGGCGACATCATCGGCGACATCCGGCAGG
CCCACTGCAACATCTCGGAGGAGAAGTGGAACAAGACCCTGCAGGAGGTGGGCAAGGAGCTGCAGAAGCACTTCCCCAACCGGAC
CATCAAGTACAACCAGTCCGCCGGCGGCGACATGGAGATCACCACGCACTCCTTCAACTGCGGTGGCGAGTTCTTCTACTGCAAC
ACGTCCAAGCTGTTCAACTCCACGTACAACGACACCTACATCTCCACGAACTCGACCAACTCGTCCGCCAACAACTCGTCCATCA
TCACGCTCCAGTGCCGGATCAAGCAGATCATCAACATGTGGCAGGGGGTGGGCCGCGCTATGTACGCACCGCCCATCGCCGGCAA
CATCATCTGCAAGTCCAACATCACCGGCCTCCTGCTGACCCGCGACGGCGGCCCGGACTCGAACAAGACGGAGACCTTCAGGCCA
GCGGGAGGCGACATGCGGGACAACTGGCGCTCCGAGCTGTACAAGTACAAGGTGGTGGAGGTCCAGCCCCTGGGCATCGCACCCA
CCGGGGCCAAGAGGCGGGTCGTGGAGCGCGAGAAGCGCGCGGCCGGCCTCGGCGCCCTGTTCCTGGGCTTCCTGGGCGCTGCGGG
CTCCACCATGGGTGCCGCGTCCATCACCCTGACCGTGCAGGCCCGCCAGCTGCTCTCCGGCATCGTGCAGCAGCAGTCCAACCTC
CTGAGGGCCATCGAGGCCCAGCAGCACATGCTGCAGCTGACCGTGTGGGGCATCAAGCAGCTGCAGGCCAGGGTGCTCGCGCTCG
AGCGCTACCTGAAGGACCAGCAGCTGCTCGGCATCTGGGGCTGCTCCGGCAAGCTGATCTGCACGACCAACGTGCCCTGGAACAC
GTCCTGGTCCAACAAGTCGGAGACCGACATCTGGGCAACATGACCTGGATGCAGTGGGAGCGCGAGATCTCCAACTACACCGAG
ACCATCTACAAGCTCCTCGAGGACTCCCAGAACCAGCAGGAGCGGAACGAGCAAGACCTGCTCGCGCTGGACTCGTGGAACTCGC
TGTGGTCGTGGTTCAACATCACCAAGTGGCTGTGGTACATCAAGATCTTCATCATGATCGTCGGCGGCCTGATCGGCCTGCGCAT
CGTGTTCGCCGTGCTGTCGATCGTGAACCGCGTGCGCCAGGGCTACTCCCCGCTGTCCCTGCAAACGCTGACCCCCAACCCCCGG
GAGCCCGACAGGCTGCGCGGGATCGAGGAGGAGGGCGGCGAGCAGGACCGCGACAAGTCCATCCGCCTGGTGAACGGCTTCCTGC
CCATCGTGTGGGACGACCTGCGCTCCCTGTGCCTGTTCTCGTACCACCGCCTGCGCGACTTCCTCCTGCTGGCGGCCCGCGTCGT
```

Figure 3 continued

```
GGAGCTGCTGGGCCGGTCCTCCCTGCGGGGCCTGCAGCGCGGCTGGGAGGTGCTCAAGTACCTGGGCTCGCTGGTGCAGTACTGG
GGCCTGGAGCTGAAGAAGTCCGCCATCTCCCTGTTCGACACCCTCGCCATCGCCGTGGCGGAGGGCACCGACCGCATCATCGAAG
CCATCCAGGGGTTCTGCCGCGCCATCCGCAACATCCCCCGGCGCATCCGCCAGGGCTTCGAGGCCTCGCTCCTGTAGTAAGaatt
cggtaaccaggtcccggatcc
>CH848.3.d1621.4.15.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCAACCCGCAGG
AGATGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCACGGTCAACTCCACC
ACCGACTACGACTCCCGGTCCAACGACTCCGTGACCAACATCACGAACACGATCAAGGAGGAGGTGAAGAACTGCTCCTTCAAGA
CCACGACGGAGATCCGCGACAAGGAGAAGAAGGAGCACGCCCTGTTCTACCGCCCCGACATCGTGCCGCTCAACTCCGAGACGGG
CAACATCTCCGAGTACAGGCTGATCAACTGCAACACCTCCGCGGTCACGCAGGCGTGCCCCAAGGTCACGTTCGAGCCCATCCCC
ATCCACTACTGCGCCCCCGCCGGCTACGCCATCCTGAAGTGCAACGACGAGACCTTCAACGGGACCGGCCCGTGCAGCAACGTGT
CCACCGTGCAGTGCACGCACGGCATCCGGCCCGTGGTGTCCACGCAGCTGCTCCTGAACGGGTCGCTGGCGAAGGAGGAGATCGT
CATCCGGTCCGAGAACCTCACGAACAACGCGAAGATCATCATCGTGCAGCTGAACACGTCCGTGGAGATCGTGTGCACCCGCCCG
GGCAACAACACGCGCAAGTCCGTGCGGATCGGCCCTGGCCAGACCTTCTACGCCACCGGCGACATCATCGGCGACATCCGGCAGG
CCCACTGCAACATCTCGGAGAAGAAGTGGAACGAGACCCTGCAGCGGGTGGGCATCGAGCTGCAGAAGCACTTCCCCAACAAGAC
CATCAAGTACAACCAGTCCGCCGGCGGCGACATGGAGATCACCACGCACTCCTTCAACTGCGGTGGCGAGTTCTTCTACTGCAAC
ACGGCCAAGCTGTTCAACTCCACGTACAACGGCACCTACATCAACACGACCTCGATCAACTCGACCCTCAACATCACGCTCCAGT
GCCGGATCAAGCAGATCATCAACATGTGGCAGGGGGTGGGCCGCGCTATGTACGCACCGCCCATCGCCGGCAACATCACCTGCCG
GTCCAACATCACCGGCCTCCTGCTGACCCGCGACGGCGGCATCCACAACGACTCGAACGAGACGGAGACCTTCAGGCCAGCGGGA
GGCGACATGCGGGACAACTGGCGCTCCGAGCTGTACAAGTACAAGGTGGTGGAGGTCCAGCCCCTGGGCATCGCACCCACCGGGG
CCAAGAGGCGGGTCGTGGAGCGCGAGAAGCGCGCGGCCGGCCTCGGCGCCCTGTTCCTGGGCTTCCTGGGCGCTGCGGGCTCCAC
CATGGGTGCCGCGTCCATCACCCTGACCGTGCAGGCCCGCCAGCTGCTCTCCGGCATCGTGCAGCAGCAGTCCAACCTCCTGAGG
GCCATCGAGGCCCAGCAGCACATGCTGCAGCTGACCGTGTGGGGCATCAAGCAGCTGCAGGCCAGGGTGCTCGCGCTCGAGCGCT
ACCTGAAGGACCAGCAGCTGCTCGGCATCTGGGGCTGCTCCGGCAAGCTGATCTGCACGACCAACGTGCCCTGGAACACGTCCTG
GTCCAACAAGTCGGAGACCGACATCTGGGGCAACATGACCTGGATGCAGTGGGAGCGCGAGATCTCCAACTACACCGAGACCATC
TACAAGCTCCTCGAGGACTCCCAGAACCAGCAGGAGCGGGAACGAGCAAGACCTGCTCGCGCTGGACTCGTGGAACTCGCTGTGGT
CGTGGTTCAACATCACCAAGTGGCTGTGGTACATCAAGATCTTCATCATGATCGTCGGCGGCCTGATCGGCCTGCGCATCGTGTT
CGCCGTGCTGTCGATCGTGAACGCGTGCGCCAGGGCTACTCCCCGCTGTCCCTGCAAACGCTGACCCCCAACCCCCGGGAGCCC
GACAGGCTGCGCGGGATCGAGGAGGAGGGCGGCGAGCAGGACCGCGACAAGTCCATCCGCCTGGTGAACGGCTTCCTGCCCATCG
TGTGGGACGACCTGCGCTCCCTGTGCCTGTTCTCGTACCACCGCCTGCGCGACTTCCTCCTGCTGGCGGCCCGCGTCGTGGAGCT
GCTGGGCCGGTCCTCCCTGCGGGGCCTGCAGCGCGGCTGGGAGGTGCTCAAGTACCTGGGCTCGCTGGTGCAGTACTGGGGCCTG
GAGCTGAAGAAGTCCGCCATCTCCCTGTTCGACACCCTCGCCGTCGCCGTGGCGGAGGGCACCGACCGCATCATCGAAGCCATCC
AGGGGTTCTGCCGCGCCATCCGCAACATCCCCCGGCGCATCCGCCAGGGCTTCGAGGCCTCGCTCCTGTAGTAAGaattcggtaa
ccgggacctggatcc
>CH848.3.d1621.4.25.optBF
gtcgacaagaaATGCGCGTGACGGGCATCCTGAAGAACTACCCGCAGTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACGAGAAGGAGGTGCACAACGTGTGGGCGACCCACGCCTGCGTGCCCACGGACCCCAGCCCGCAGG
AGCTCTTCCTGGAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGACCGCCACGGTGAACAACTCC
ACGGTGGACGAGATGAAGAACTGCTCCTTCAACGCCACGACGGAGATCCGCGACAAGAAGAAGGAGTACGCCCTGTTCTACC
GCTCGGACGTCGTGTCCCTGGACGAGACGAACAACACGTCCGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACGACGAGACC
TTCAACGGGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGAGATCGTCATCCGGTCCGAGAACCTCACGAACAACGCGAAGACGATCATCGTGCACCTGCA
CGCCCCGGTGGAGATCGTGTGCACCCGCCCGGGCCACAACACGCGCAAGTCCGTGCGGATCGGCCCTGGCCAGACCTTCTACGCC
ACCGGCGACATCATCGGCAACATCCGGCAGGCCCACTGCAACATCAACGAGTCGGAGTGGAACGAGACCCTGCAGAAGGTGGGCA
AGGAGCTGCGCAAGCACTTCCCCAACAAGACCATCAAGTACGAGCAGTCCGCCGGCGGCGACATGGAGATCACCACGCACTCCTT
CAACTGCGGTGGCGAGTTCTTCTACTGCAACACGGCCAACTGTTCAACGGCACGTACAACGGACCCGACATCTCCACGAACTCG
TCCGCCGACCGCAACTCCACGATCACGCTCGAGTGCAAGATCAAGCAGATCATCAACATGTGGCAGGGGGTGGGCCGCGCTATGT
ACGCACCGCCCATCGCCGGCAACATCACCTGCCGCTCCAACATCACCGGCCTCCTGCTGACCCGCGACGGCGGCATCAACAACGT
GTCGAACGCCACGGAGACCTTCAGGCCAGCGGGAGGCGACATGCGCGACAACTGGCGCTCCGAGCTGTACAAGTACAAGGTGGTG
```

Figure 3 continued

```
GAGGTCCAGCCCCTGGGCATCGCACCCACCGGGGCCAAGAGGCGGGTCGTGGAGCGCGAGAAGCGCGCGGTGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCTCTC
CGGCATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGCTGA
TCTGCACGACCAACGTGCCCTGGAACACGTCCTGGTCCAACAAGTCGGAGATGGACATCTGGAACAACATGACCTGGATGCAGTG
GGAGCGCGAGATCTCCAACTACACCGAGACCATCTACATGCTCCTCGAGGACTCCCAGCGCCAGCAGGAGCGGAACGAGAAAGAC
CTGCTCGCGCTGGACTCGTGGAACTCGCTGTGGAACTGGTTCAACATCACCAACTGGCTGTGGTACATCAAGATCTTCATCATGA
TCGTCGGCGGCCTGATCGGCCTGCGCATCGTGTTCGCCGTGCTGTCGATCGTGAACCGCGTGCGCCAGGGCTACTCCCCGCTGTC
CCTGCAAACGCTGACCCCCAACCCCCGGGAGCCCGACAGGCTGCGCGGGATCGAGGAGGAGGGCGGCGAGCAGGACCGCGACCGG
TCCATCCGCCTGGTGTCGGGCTTCCTGCCCATCGTGTGGGACGACCTGCGCTCCCTGTGCCTGTTCTCGTACCACCGCCTGCGCG
ACTTCCTCCTGCTGGCGGCCCGCGTCGTGGAGCTGCTGGGCCACTCCTCCCTGCGGGGCCTGCAGCGCGGCTGGGAGGTGCTCAA
GTACCTGGGCTCGCTGGTGCAGTACTGGGGCCTGGAGCTGAAGCGGTCCACCATCTCCCTGTTCGACACCCTCGCCATCGCCGTG
GCGGAGGGCACCGACCGCATCATCGAACTCATCCAGGGGTTCTGCCGCGCCATCCGCAACATCCCCACGCGCATCCGCCAGGGCT
TCGAGGCCTCGCTCCTGTAGTAAGaattcggtaaccgggtcctggatcc
>CH848.3.d1621.4.31.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
AACGCCACCGTCGAGAACTCCACGGAGGCCATGAAGAACTGCTCCTTCAACACCACGACGGAGATCCGCGACAAGATCAAGAAGG
AGCGGGCCCTGTTCTACCGCCCCGACATCGTGCCGCTCAACGACGAGACGAACAACACCTCCAAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACGACGAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCGGAGAAGGAGATCGTCATCCGGTCCGAGAACCTCACGAACAACGCGAA
GATCATCATCGTGCACCTGCACACGCCGGTGCAGATCGTGTGCACCCGCCCGTACAACAACACGCGCAAGTCCGTGCGGATCGGC
CCTGGCCAGACCTTCTACGCCACCGGCGACATCATCGGCGACCCGCGGAAGGCCCACTGCAACATCTCGGAGAAGGACTGGAACA
AGACCCTGCAGGAGGTGGGCAAGGAGCTGCAGAAGCACTTCCCCAACAAGACCATCCGGTACAACCAGTCCGCCGGCGGCGACAT
GGAGATCACCACGCACTCCTTCAACTGCGGTGGCGAGTTCTTCTACTGCAACACGTCCAAGCTGTTCAACTCCACGTACAACGAC
ACCTACATCTCCACGAACTCGACCAACTCGTCGGCCAACAACTCGTCCATCATCACGCTCCAGTGCCGGATCAAGCAGATCATCA
ACATGTGGCAGGGGGTGGGCCGCGCTATGTACGCACCGCCCATCGCCGGCAACATCACCTGCAAGTCCAACATCACCGGCCTCCT
GCTGACCCGCGACGGCGGCCCCGACAACAAGACGGAGACCTTCAGGCCAGCGGGAGGCGACATGCGGGACAACTGGCGCTCCGAG
CTGTACAAGTACAAGGTGGTGGAGGTCCAGCCCCTGGGCATCGCACCCACCGGGGCCAAGAGGCGGGTCGTGGAGCGCGAGAAGC
GCGCGGTGGGCCTCGGCGCCCTGTTCCTGGGCTTCCTGGGCGCTGCGGGCTCCACCATGGGTGCCGCGTCCATCACCCTGACCGT
GCAGGCCCGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTCGGCATCT
GGGGCTGCTCCGGCAAGCTGATCTGCACGACCAACGTGCCCTGGAACACGTCCTGGTCCAACAAGTCGGAGACCGACATCTGGGG
CAACATGACCTGGATGCAGTGGGAGCGCGAGATCTCCAACTACACCGAGACCATCTACAAGCTCCTCGAGGACTCCCAGAACCAG
CAGGAGCGGAACGAGCAAGACCTGCTCGCGCTGGACTCGTGGAACTCGCTGTGGTCGTGGTTCAACATCACCAAGTGGCTGTGGT
ACATCAAGATCTTCATCATGATCGTCGGCGGCCTGATCGGCCTGCGCATCGTGTTCGCCGTGCTGTCGATCGTGAACCGCGTGCG
CCAGGGCTACTCCCCGCTGTCCCTGCAAACGCTGACCCCCAACCCCCGGGAGCCCGACAGGCTGCGCGAGATCGAGGAGGAGGGC
GGCGAGCAGGACCGCGACCGCTCCATCCGCCTGGTGTCCGGCTTCCTGCCCATCGTGTGGGACGACCTGCGCTCCCTGTGCCTGT
TCTCGTACCACCGCCTGCGCGACTTCCTCCTGCTGGCGGCCCGCGTCGTGGAGCTGCTGGGCCACTCCTCCCTGCGGGGCCTGCA
GCGCGGCTGGGAGGTGCTCAAGTACCTGGGCTCGCTGGTGCAGTACTGGGGCCTGGAGCTGAAGCGGTCCACCATCTCCCTGTTC
GACACCCTCGCCATCGCCGTCGCGGAGGGCACCGACCGCATCATCGAACTCATCCAGGGGTTCTGCCGCGCCATCCGCAACATCC
CCACCCGCATCCGCCAGGGCTTCGAGGCCTCGCTCCTGTAGTAAGaattcggttaccgggtcccggatcc
>CH848.3.d1621.4.44.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
ACGACCGAGAAGATGTCCAACGTCACCGTCAACAACATCACCATCGAGGAGATGAAGAACTGCTCCTTCAACACCACGACGGAGA
TCCGCGACAAGATCAAGAAGGAGCGGGCCCTGTTCTACCGCCCCGACATCGTGCCGCTGAACGACGAGACGAACAACACCTCCAA
GTACAGGCTGATCAACTGCAACACCTCCGCGGTCACGCAGGCGTGCCCCAAGGTCACGTTCGAGCCCATCCCCATCCACTACTGC
```

Figure 3 continued

```
GCCCCCGCCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCCGGTCCGA
GAACCTCACGAACAACGCGAAGATCATCATCGTGCACCTGCACGCCCCGGTGGAGATCGTGTGCACCCGCCCGTACAACAACACG
CGCAAGTCCGTGCGGATCGGCCCTGGCCAGACCTTCTACGCCACCGGCGACATCATCGGCGACCCGCGGCAGGCCCACTGCAACA
TCTCGAAGGAGATCTGGAACAAGACCCTGCAGGAGGTGGGCAAGGAGCTGCAGAAGCACTTCCCCAACAAGACCATCCGGTACAA
CCAGTCCGCCGGCGGCGACATGGAGATCACCACGCACTCCTTCAACTGCGGTGGCGAGTTCTTCTACTGCAACACGTCCAACCTG
TTCAACTCCACGTACAACGACACCTACATCTCCCCCAACTCGACCAACTCGACGTCCATCATCACGCTCCAGTGCAAGATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCATCAACAACGTGTCCAACGAGACGGAGACCTTCAGGCCAGCGGGAGGCGACATGCGG
GACAACTGGCGCTCCGAGCTGTACAAGTACAAGGTGGTGGAGGTCCAGCCCCTGGGCATCGCACCCACCGGGGCCAAGAGGCGGG
TCGTGGAGCGCGAGAAGCGCGCGGTGGGCCTCGGCGCCCTGTTCCTGGGCTTCCTGGGCGCTGCGGGCTCCACCATGGGTGCCGC
GTCCATCACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTGAAGGACC
AGCAGCTGCTCGGCATCTGGGGCTGCTCCGGCAAGCTGATCTGCACGACCAACGTGCCCTGGAACACGTCCTGGTCCAACAAGTC
GGAGACCGACATCTGGAACAACATGACCTGGATGCAGTGGGAGCGCGAGATCTCCAACTACACCGGGACCATCTACAAGCTCCTC
GAGGACTCCCAGAACCAGCAGGAGCGGAACGAGAAGGATCTGCTCGCGCTGGACTCGTGGAACTCGCTGTGGTCGTGGTTCAACA
TCACCAAGTGGCTGTGGTACATCAAGATCTTCATCATGATCGTCGGCGGCCTGATCGGCCTGCGCATCGTGTTCGCCGTGCTGTC
GATCGTGAACCGCGTGCGCCAGGGCTACTCCCCGCTGTCCCTGCAAACGCTGACCCCCAACCCCCGGGAGCCCGACAGGCTGCGC
CGGATCGAGGAGGAGGGCGGCGAGCAGGACCGCGACAAGTCCATCCGCCTGGTGAACGGCTTCCTGCCCATCGTGTGGGACGACC
TGCGCTCCCTGTGCCTGTTCTCGTACCACCGCCTGCGCGACTTCCTCCTGCTGGCGGCCCGCGTCGTGGAGCTGCTGGGCCGGTC
CTCCCTGCGGGGCCTGCAGCGCGGCTGGGAGGTGCTCAAGTACCTGGGCTCGCTGGTGCAGTACTGGGGCCTGGAGCTGAAGAAG
TCCGCCATCTCCCTGTTCGACACCCTCGCCGTGGCCGTCGCGGAGGGCACCGACCGCATCATCGAACTCATCCAGGGGTTCTGCC
GCGCCATCCGCAACATCCCCCGGCGCATCCGCCAGGGCTTCGAGGCCTCGCTCCTGTAGTAAGaattcggttaccaggacccgga
tcc
>CH848.3.d1621.4.46.optBF
gtcgacaagaaATGCGCGTGATGGGCATCCTGAAGAACTACCCGCGGTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCTCGCCGCAGG
AGCTGGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCATCGTCAAGAACTCC
ACGACCGAGGAGCTGTCCAACGCCCTCGCGCGGAACTCGACCACCGAGGAGATGAAGAACTGCTCCTTCAACACCACGACGGAGA
TCCGCGACAAGGAGAAGAAGGAGTACGCCCTGTTCTACCGCCCCGACATCGTGCCGCTGAACAACAAGACGTCCAACATCTCCGA
GTACAGGCTGATCAACTGCAACACCTCCACCGTCACGCAGGCGTGCCCCAAGGTCACGTTCGAGCCCATCCCCATCCACTACTGC
GCCCCCGCCGGCTACGCCATCCTGAAGTGCAACAACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAAGGAGGGCATCGTCATCCGGTCCGA
GAACCTCACGAACAACGCGAAGATCATCATCGTGCAGCTGAACGCCAACGCCTCGGTGGAGATCGTGTGCACCCGCCCGAACAAC
AACACGCGCAAGTCCGTGCGGATCGGCCCTGGCCAGACCTTCTACGCCACCGGCGACATCATCGGCAACATCCGGCAGGCCCACT
GCAACATCTCGGAGAAGAAGTGGAACGAGACCCTGCAGAAGGTGGGCATCGAGCTGCAGAAGCACTTCCCCAACAAGACCATCAA
GTACAACCAGTCCGCCGGCGGCGACATGGAGATCACCACGCACTCCTTCAACTGCGGTGGCGAGTTCTTCTACTGCAACACGGCC
AAGCTGTTCAACTCCACGTACAACGGCACCTACATCTCCACGAACTCGATCAACTCGACGCTGAACATCACGCTCCAGTGCCGGA
TCAAGCAGATCATCAACATGTGGCAGGGGTGGGCCGCGCTATGTACGCACCGCCCATCGCCGGCAACATCACCTGCCGGTCCAA
CATCACCGGCCTCCTGCTGACCCGCGACGGCGGCATCCACAACGACTCCAACGAGACGGAGACCTTCAGGCCAGCGGGAGGCGAC
ATGCGGGACAACTGGCGCTCCGAGCTGTACAAGTACAAGGTGGTGGAGATCCAGCCCCTGGGCATCGCACCCACCGGGGCCAAGA
GGCGGGTCGTGGAGCGCGAGAAGCGCGCGGCCGGCCTCGGCGCCCTGTTCCTGGGCTTCCTGGGCGCTGCGGGCTCCACCATGGG
TGCCGCGTCCATCACCCTGACCGTGCAGGCCCGCCAGCTGCTCTCCGGCATCGTGCAGCAGCAGTCCAACCTCCTGAGGGCCATC
GAGGCCCAGCAGCACATGCTGCAGCTGACCGTGTGGGGCATCAAGCAGCTGCAGGCCAGGGTGCTCGCGCTCGAGCGCTACCTGA
AGGACCAGCAGCTGCTCGGCATCTGGGGCTGCTCCGGCAAGCTGATCTGCACGACCAACGTGCCCTGGAACACGTCCTGGTCCAA
CAAGTCGGAGACCGACATCTGGAACAACATGACCTGGATGCAGTGGGAGCGCGAGATCTCCAACTACACCGGGACCATCTACAAG
CTCCTCGAGGAGTCCCAGAACCAGCAGGAGCGGAACGAGCAAGACCTGCTCGCGCTGGACTCGTGGAACTCGCTGTGGAACTGGT
TCAACATCACCAAGTGGCTGTGGTACATCAAGATCTTCATCATGATCGTCGGCGGCCTGATCGGCCTGCGCATCGTGTTCGCCGT
GCTGTCGATCGTGAACCGCGTGCGCCAGGGCTACTCCCCGCTGTCCCTGCAAACGCTGACCCCCAACCCCCGGGAGCCCGACAGG
CTGCGCGGCATCGAGGAGGAGGGCGGCGAGCAGGACCGCGACAAGTCCATCCGCCTGGTGAACGGCTTCCTGCCCATCGTGTGGG
ACGACCTGCGCTCCCTGTGCCTGTTCTCGTACCACCGCCTGCGCGACTTCCTCCTGCTGGCGGCCCGCGTCGTGGAGCTGCTGGG
CCGGTCCTCCCTGCGGGGCCTGCAGCGCGGCTGGGAGGTGCTCAAGTACCTGGGCTCGCTGGTGCAGTACTGGGGCCTGGAGCTG
AAGAAGTCCGCCATCTCCCTGTTCGACACCCTCGCCGTGGCCGTCGCGGAGGGCACCGACCGCATCATCGAAGCCATCCAGGGGT
```

Figure 3 continued

```
TCTGCCGCGCCATCCGCAACATCCCCCGGCGCATCCGCCAGGGCTTCGAGGCCTCGCTCCTGTAGTAAGaattcggttaccaggt
cccggatcc
>CH848.3.d1635.10.35.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
ACGACCGAGGAGATCAGCAACGCCACCGTCAAGAACATCACCATCAAGGAGATGAAGAACTGCTCCTTCAACACCACGACGGAGA
TCCGCGACAAGATCAAGAAGGAGCGGGCCCTGTTCTACCGCACCGACATCGTGCCGCTGAACAAGGAGACGGGCAACATCTCCGA
GTACAGGCTGATCAACTGCAACACCTCCGCGGTCACGCAGGCGTGCCCCAAGGTCACGTTCGAGCCCATCCCCATCCACTACTGC
GCCCCCGCCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCCGGTCCGA
GAACCTCACGAACAACGCGAAGATCATCATCGTGCACCTGCACAACCCGGTGGAGATCGTGTGCACCCGCCCGTACAACAACACG
CGCAAGTCCGTGCGGATCGGCCCTGGCCAGACCTTCTACGCCACCGGCGACATCATCGGCGACCCGCGGCAGGCCCACTGCAACA
TCTCGAAGGAGGAGTGGAACAAGACCCTGCAGGAGGTGGGCAAGGAGCTGCAGAAGCACTTCCCCAACAAGACCATCCGGTACAA
CCAGTCCGCCGGCGGCGACATGGAGATCACCACGCACTCCTTCAACTGCGGTGGCGAGTTCTTCTACTGCAACACGTCCAACCTG
TTCAACTCCACGTACAACGACACCTACATCTCCCCCAACTCGACCAACTCGACGTCCATCATCACGCTCCAGTGCCGGATCAAGC
AGATCATCAACATGTGGCAGGGGGTGGGCCGCGCTATGTACGCACCGCCCATCGCCGGCAACATCACCTGCAAGTCCAACATCAC
CGGCCTCCTGCTGACCCGCGACGGCGGCATCAACAACGTGTCCAACGAGACGGAGACCTTCAGGCCAGCGGGAGGCGACATGCGG
GACAACTGGCGCTCCGAGCTGTACAAGTACAAGGTGGTGGAGGTCCAGCCCCTGGGCATCGCACCCACCGGGGCCAAGAGGCGGG
TCGTGGAGCGCGGCAAGCGCGCGGCCGGCCTCGGCGCCCTGTTCCTGGGCTTCCTGGGCGCTGCGGGCTCCACCATGGGTGCCGC
GTCCATCACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTGAAGGACC
AGCAGCTGCTCGGCATCTGGGGCTGCTCCGGCAAGCTGATCTGCACGACCAACGTGCCCTGGAACACGTCCTGGTCCAACAAGTC
GGAGATGGACATCTGGAACAACATGACCTGGATGCAGTGGGAGCGCGAGATCTCCAACTACACCGGGACCATCTACAAGCTCCTC
GAGGACTCCCAGAACCAGCAGGAGCGGGAACGAGCAAGACCTGCTCGCGCTGGACTCGTGGAACTCGCTGTGGAACTGGTTCGACA
TCACCAAGTGGCTGTGGTACATCAAGATCTTCATCATGATCGTCGGCGGCCTGATCGGCCTGCGCATCATCTTCGCCGTGCTGTC
GATCGTGAACCGCGTGCGCCAGGGCTACTCCCCGCTGTCCCTGCAAACGCTGACCCCCAACCCCCGGGAGCCCGACAGGCTGCGC
GGGATCGAGGAGGAGGGCGGCGAGCAGGACCGCGACAAGTCCATCCGCCTGGTGAACGGCTTCCTGCCCATCGTGTGGGACGACC
TGCGCTCCCTGTGCCTGTTCTCGTACCACCGCCTGCGCGACTTCCTCCTGCTGGCGGCCCGCGTCGTGGAGCTGCTGGGCCGGTC
CTCCCTGCGGGGCCTGCAGCGCGGCTGGGAGGTGCTCAAGTACCTGGGCTCGCTGGTGCAGTACTGGGGCCTGGAGCTGAAGAAG
TCCGCCATCTCCCTGTTCGACACCCTCGCCGTGGCCGTCGCGGAGGGCACCGACCGCATCATCGAAGCCATCCAGGGGTTCTGCC
GCGCCATCCGCAACATCCCCCGGCGCATCCGCCAGGGCTTCGAGGCCTCGCTCCTGTAGTAAGaattcggttaccgggacctgga
tcc
>CH848.3.d1651.7.34.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
ACGACCGAGAAGATGAGCAACGTCACCGTCAACAACATCACCATCGAGGAGATGAAGAACTGCTCCTTCAACACCACGACGGAGA
TCCGCGACAAGATCAAGAAGGAGCGGGCCCTGTTCTACCGCCCGGACATCGTGCCGCTGAACGACGAGACGAACAACACCTCCAA
GTACAGGCTGATCAACTGCAACACCTCCGCGGTCACGCAGGCGTGCCCCAAGGTCACGTTCGAGCCCATCCCCATCCACTACTGC
GCCCCCGCCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCCGGTCCGA
GAACCTCACGAACAACGTGAAGACCATCATCGTGCACCTGCACGCCCCGGTGGAGATCGTGTGCACCCGCCCGTACAACAACACG
CGCAAGTCCGTGCGGATCGGCCCTGGCCAGACCTTCTACGCCACCGGCGACATCATCGGCGACCCGCGGAAGGCCCACTGCAACA
TCTCGGAGAAGGACTGGAACAAGACCCTGCAGGAGGTGGGCAAGGAGCTGCAGAAGCACTTCCCCAACAAGACCATCCGGTACAA
CCAGTCCGCCGGCGGCGACATGGAGATCACCACGCACTCCTTCAACTGCGGTGGCGAGTTCTTCTACTGCAACACGTCCAAGCTG
TTCAACTCCACGTACAACGACACCTACATCTCCACCAACTCGACCAACTCGTCGGCCAACAACTCGTCCATCATCACGCTCCAGT
GCCGGATCAAGCAGATCATCAACATGTGGCAGGGGGTGGGCCGCGCTATGTACGCACCGCCCATCGCCGGCAACATCACCTGCAA
GTCCAACATCACCGGCCTCCTGCTGACCCGCGACGGCGGCCCGGACAACAAGACGGAGACCTTCAGGCCAGCGGGAGGCGACATG
CGGGACAACTGGCGCTCCGAGCTGTACAAGTACAAGGTGGTGGAGGTCCAGCCCCTGGGCATCGCACCCACCGGGGCCAAGAGGC
GGGTCGTGGAGCGCGAGAAGCGCGCGGTCGGCCTCGGCGCCCTGTTCCTGGGCTTCCTGGGCGCTGCGGGCTCCACCATGGGTGC
```

Figure 3 continued

```
CGCGTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATCTGGGGCTGCTCCGGCAAGCTGATCTGCACGACCAACGTGCCCTGGAACACGTCCTGGTCCAACAA
GTCGGAGACCGACATCTGGGGCAACATGACCTGGATGCAGTGGGAGCGCGAGATCTCCAACTACACCGAGACCATCTACAAGCTC
CTCGAGGACTCCCAGAACCAGCAGGAGCGGAACGAGCAAGACCTGCTCGCGCTGGACTCGTGGAACTCGCTGTGGTCCTGGTTCA
ACATCACCAAGTGGCTGTGGTACATCAAGATCTTCATCATGATCGTCGGCGGCCTGATCGGCCTGCGCATCGTCTTCGCCGTGCT
GTCGATCGTGAACCGCGTGCGCCAGGGCTACTCCCCGCTGTCCCTGCAAACGCTGACCCCCAACCCCGGGAGCCCGACAGGCTG
CGCGAGATCGAGGAGGAGGGCGGCGAGCAGGACCGCGACCGGTCCATCCGCCTGGTGTCCGGCTTCCTGCCCATCGTGTGGGACG
ACCTGCGCTCCCTGTGCCTGTTCTCGTACCACCGCCTGCGCGACTTCCTCCTGCTGGCGGCCCGCGTCGTGGAGCTGCTGGGCCA
CTCCTCCCTGCGGGGCCTGCAGCGCGGCTGGGAGGTGCTCAAGTACCTGGGCTCGCTGGTGCAGTACTGGGGCCTGGAGCTGAAG
CGGTCCACCATCTCCCTGTTCGACACCCTCGCCATCGCCGTCGCGGAGGGCACCGACCGCATCATCGAACTGATCCAGGGGTTCT
GCCGCGCCATCCGCAACATCCCCACGCGCATCCGCCAGGGCTTCGAGGCCTCGCTCCTGTAGTAAGaattcggttaccgggtcct
ggatcc
>CH848.3.d1651.7.50.optBF
gtcgacaagaaATGCGCGTGATGGGCATCCTGAAGAACTACCCGCGGTGGTGGATCTGGGGCATCCTGGGCTTCTGGATGCTCAT
GATCTGCAACGGCAAGGGCAAGCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCTCGCCGCAGG
AGCTGGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCATCGTCAAGAACTCC
ACGACCGAGGAGCTGTCCAACGCCCTCGCGCGGAACTCGACCACCGAGGAGATGAAGAACTGCTCCTTCAACACCACGACGGAGA
TCCGCGACAAGGAGAAGAAGGAGTACGCCCTGTTCTACCGCCCCGACATCGTGCCGCTGAACAACAAGACGTCCAACATCTCCGA
GTACAGGCTGATCAACTGCAACACCTCCACCGTCACGCAGGCGTGCCCCAAGGTCACGTTCGAGCCCATCCCCATCCACTACTGC
GCCCCCGCCGGCTACGCCATCCTGAAGTGCAACAACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGGCATCGTCATCCGGTCCGA
GAACCTCACGAACAACGCGAAGATCATCATCGTGCAGCTGAACGCCAACGCCTCGGTGGAGATCGTGTGCACCCGCCCGAACAAC
AACACGCGCAAGTCCGTGCGGATCGGCCCTGGCCAGACCTTCTACGCCACCGGCGACATCATCGGCAACATCCGGCAGGCCCACT
GCAACATCTCGGAGAAGAAGTGGAACGAGACCCTGCAGAAGGTGGGCATCGAGCTGCAGAAGCACTTCCCCAACAAGACCATCAA
GTACAACCAGTCCGCCGGCGGCGACATGGAGATCACCACGCACTCCTTCAACTGCGGTGGCGAGTTCTTCTACTGCAACACGACC
AAGCTGTTCAACTCCACGTACAACGGCACCTACATCTCCACGAACTCGATCAACTCGACGCTGAACATCACGCTCCAGTGCCGGA
TCAAGCAGATCATCAACATGTGGCAGGGGATCGGCCGCGCTATGTACGCACCGCCCATCGCCGGCAACATCACCTGCCGGTCCAA
CATCACCGGCCTCCTGCTGACCCGCGACGGCGGCATCCACAACGACTCCAACGAGACGGAGACCTTCAGGCCAGCGGGAGGCGAC
ATGCGGGACAACTGGCGCTCCGAGCTGTACAAGTACAAGGTGGTGGAGATCCAGCCCCTGGGCATCGCACCCACCGGGGCCAAGA
GGCGGGTCGTGGAGCGCGGGAAGCGCGCGGCCGGCCTCGGCGCCTGTTCCTGGGCTTCCTGGGCGCTGCGGGCTCCACCATGGG
TGCCGCGTCCATCACCCTGACCGTGCAGGCCCGCCAGCTGCTCTCCGGCATCGTGCAGCAGCAGTCCAACCTCCTGAGGGCCATC
GAGGCCCAGCAGCACATGCTGCAGCTGACCGTGTGGGGCATCAAGCAGCTGCAGGCCAGGGTGCTCGCGCTCGAGCGCTACCTGA
AGGACCAGCAGCTGCTCGGCATCTGGGGCTGCTCCGGCAAGCTGATCTGCACGACCAACGTGCCCTGGAACACGTCCTGGTCCAA
CAAGTCGGAGATGGACATCTGGGACAACATGACCTGGATGCAGTGGGAGCGCGAGATCTCCAACTACACCGGGACCATCTACAAG
CTCCTCGAGGACTCCCAGAACCAGCAGGAGCGGAACGAGCAAGACCTGCTCGCGCTGGACTCGTGGAACTCGCTGTGGAACTGGT
TCGACATCACCAAGTGGCTGTGGTACATCAAGATCTTCATCATGATCGTCGGCGGCCTGATCGGCCTGCGCATCGTGTTCGCCGT
GCTGTCGATCGTGAACCGCGTGCGCCAGGGCTACTCCCCGCTGTCCCTGCAAACGCTGACCCCCAACCCCGGGAGCCCGACAGG
CTGCGCGGCATCGAGGAGGAGGGCGGCGAGCAGGACCGCGACAAGTCCATCCGCCTGGTGAACGGCTTCCTGCCCATCGTGTGGG
ACGACCTGCGCTCCCTGTGCCTGTTCTCGTACCACCGCCTGCGCGACTTCCTCCTGCTGGCGGCCCGCGTCGTGGAGCTGCTGGG
CCGGTCCTGCCTGCGGGCCTGCAGCGCGGCTGGGAGGTGCTCAAGTACCTGGGCTCGCTGGTGCAGTACTGGGGCCTGGAGCTG
AAGAAGTCCGCCATCTCCCTGTTCGACACCCTCGCCGTGGCCGTCGCGGAGGGCACCGACCGCATCATCGAAGTCATCCAGGGGT
TCTGCCGCGCCATCCGCAACATCCCCCGGCGCATCCGCCAGGGCTTCGAGGCCTCGCTCCTGTAGTAAGgtgaccgggacccgaa
ttcggatcc
>CH848.3.d1651.10.04.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
AACGCCACGGTCGAGAACTCCACGGAGGCCATGAAGAACTGCTCCTTCAACACCACGACGGAGATCCGCGACAAGATCAAGAAGG
AGCGGGCCCTGTTCTACCGCCCCGACATCGTGCCGCTCAACAACGAGACGGGCAACATCTCCGAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
```

Figure 3 continued

```
CTGAAGTGCAACGACGAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCGGAGAAGGAGATCGTCATCCGGTCCGAGAACCTCACGAACAACGCGAA
GATCATCATCGTGCACCTGCACAACCCGGTGGAGATCGTGTGCACCCGCCCGTACAACAACACGCGCAAGTCCGTGCGGATCGGC
CCTGGCCAGACCTTCTACGCCACCGGCGACATCATCGGCGACCCGCGGAAGGCCCACTGCAACATCTCGAAGGAGGAGTGGAACA
AGACCCTGCAGGAGGTGGGCAAGGAGCTGCAGAAGCACTTCCCCAACAAGACCATCCGGTACAACCAGTCCGCCGGCGGCGACAT
GGAGATCACCACGCACTCCTTCAACTGCGGTGGCGAGTTCTTCTACTGCAACACGTCCAACCTGTTCAACTCCACGTACAACGAC
ACCTACATCTCCCCGAACTCGACCAACTCGACCTCCATCATCACGCTCCAGTGCCGGATCAAGCAGATCATCAACATGTGGCAGG
GGGTGGGCCGCGCTATGTACGCACCGCCCATCGCCGGCAACATCACCTGCAAGTCCAACATCACCGGCCTCCTGCTGACCCGCGA
CGGCGGCCCCGAGTCCAACGAGACGGAGACCTTCAGGCCAGCGGGAGGCGACATGCGGGACAACTGGCGCTCCGAGCTGTACAAG
TACAAGGTGGTGGAGGTCCAGCCCCTGGGCATCGCACCCACCGGGGCCAAGAGGCGGGTCGTGGAGCGCGAGAAGCGCGCGGCCG
GCCTCGGCGCCCTGTTCCTGGGCTTCCTGGGCGCTGCGGGCTCCACCATGGGTGCCGCGTCCATCACCCTGACCGTGCAGGCCCG
CCAGCTGCTCTCCGGCATCGTGCAGCAGCAGTCCAACCTCCTGAGGGCCATCGAGGCCCAGCAGCACATGCTGCAGCTGACCGTG
TGGGGCATCAAGCAGCTGCAGGCCAGGGTGCTCGCGCTCGAGCGCTACCTGAAGGACCAGCAGCTGCTCGGCATCTGGGGCTGCT
CCGGCAAGCTGATCTGCACGACCAACGTGCCCTGGAACACGTCCTGGTCCAACAAGTCGGAGACCGACATCTGGGGCAACATGAC
CTGGATGCAGTGGGAGCGCGAGATCTCCAACTACACCGAGACCATCTACAAGCTCCTCGAGGACTCCCAGAACCAGCAGGAGCGG
AACGAGCAAGACCTGCTCGCGCTGGACTCGTGGAACTCGCTGTGGTCGTGGTTCAACATCACCAAGTGGCTGTGGTACATCAAGA
TCTTCATCATGATCGTCGGCGGCCTGATCGGCCTGCGCATCGTGTTCGCCGTGCTGTCGATCGTGAACCGCGTGCGCCAGGGCTA
CTCCCCGCTGTCCCTGCAAACGCTGACCCCCAACCCCGGGAGCCCGACAGGCTGCGCGGGATCGAGGAGGAGGGCGGCGAGCAG
GACCGCGACCGCTCCATCCGCCTGGTGTCCGGCTTCCTGCCCATCGTGTGGGACGACCTGCGCTCCCTGTGCCTGTTCTCGTACC
ACCGCCTGCGCGACTTCCTCCTGCTGGCGGCCCGCGTCGTGGAGCTGCTGGGCCACTCCTCCCTGCGGGGCCTGCAGCGCGGCTG
GGAGGTGCTCAAGTACCTGGGCTCGCTGGTGCAGTACTGGGGCCTGGAGCTGAAGCGGTCCACCATCTCCCTGTTCGACACCCTC
GCCATCGCCGTCGCGGAGGGCACCGACCGCATCATCGAACTCATCCAGGGGTTCTGCCGCGCCATCCGCAACATCCCCACCCGCA
TCCGCCAGGGCTTCGAGGCCTCGCTCCTGTAGTAAGgtcacgggacccgaattcggatcc
>CH848.3.d1677.521..optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACAAGAAGGAGGTGCACAACGTGTGGGCGACCCACGCCTGCGTGCCCACGGACCCCTCGCCGCAGG
AGCTGTTCCTGAAGAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGATCTGCTCGAACGCCATCGTCAAGAACTCC
AACGCCACCGTCGGGAACTCCACGGAGGCCATGAAGAACTGCTCCTTCAACACCACGACGGAGATCCGCGACAAGATCAAGAAGG
AGCGGGCCCTGTTCTACCGCCCCGACATCGTGCCGCTGAACGACGAGACGAACAACACCTCCAAGTACAGGCTGATCAACTGCAA
CACCTCCGCGGTCACGCAGGCGTGCCCCAAGGTCACGTTCGAGCCCATCCCCATCCACTACTGCGCCCCCGCCGGCTACGCCATC
CTGAAGTGCAACGACGAGACCTTCAACGGGACCGGCCCGTGCAGCAACGTGTCCACCGTGCAGTGCACGCACGGCATCCGGCCCG
TGGTGTCCACGCAGCTGCTCCTGAACGGGTCGCTGGCGGAGAAGGAGATCGTCATCCGGTCCGAGAACCTCACGAACAACGTGAA
GATCATCATCGTGCACCTGCACAACCCGGTGCAGATCGTGTGCACCCGCCCGTACAACAACACGCGCAAGTCCGTGCGGATCGGC
CCTGGCCAGACCTTCTACGCCACCGGCGACATCATCGGCGACCCGCGGAAGGCCCACTGCAACATCTCGGAGAAGGACTGGAACA
AGACCCTGCAGGAGGTGGGCAAGGAGCTGCAGAAGCACTTCCCCAACAAGACCATCCGGTACAACCAGTCCGCCGGCGGCGACAT
GGAGATCACCACGCACTCCTTCAACTGCGGTGGCGAGTTCTTCTACTGCAACACGTCCAAGCTGTTCAACTCCACGTACAACGAC
ACCTACATCTCCACGAACTCGACCAACTCGTCGGCCAACAACTCGTCCATCATCACGCTCCAGTGCCGGATCAAGCAGATCATCA
ACATGTGGCAGGGGGGTGGGCCGCGCTATGTACGCACCGCCCATCGCCGGCAACATCACCTGCAAGTCCAACATCACCGGCCTCCT
GCTGACCCGCGACGGCGGCCCCGACAACAAGACGGAGACCTTCAGGCCAGCGGGAGGCGACATGCGGGACAACTGGCGCTCCGAG
CTGTACAAGTACAAGGTGGTGGAGGTCCAGCCCCTGGGCATCGCACCCACCGGGGCCAAGAGGCGGGTCGTGGAGCGCGAGAAGC
GCGCGGTGGGCCTCGGCGCCCTGTTCCTGGGCTTCCTGGGCGCTGCGGGCTCCACCATGGGTGCCGCGTCCATCACCCTGACCGT
GCAGGCCCGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTCGGCATCT
GGGGCTGCTCCGGCAAGCTGATCTGCACGACCAACGTGCCCTGGAACACGTCCTGGTCCAACAAGTCGGAGACCGACATCTGGGG
CAACATGACCTGGATGCAGTGGGAGCGCGAGATCTCCAACTACACCGAGACCATCTACAAGCTCCTCGAGGACTCCCAGAACCAG
CAGGAGCGGAACGAGCAAGACCTGCTCGCGCTGGACTCGTGGAACTCGCTGTGGTCGTGGTTCAACATCACCAAGTGGCTGTGGT
ACATCAAGATCTTCATCATGATCGTCGGCGGCCTGATCGGCCTGCGCATCGTGTTCGCCGTGCTGTCGATCGTGAACCGCGTGCG
CCAGGGCTACTCCCCGCTGTCCCTGCAAACGCTGACCCCCAACCCCGGGAGCCCGACAGGCTGCGCGGGATCGAGGAGGAGGGC
GGCGAGCAGGACCGCGACCGCTCCATCCGCCTGGTGTCCGGCTTCCTGCCCATCGTGTGGGACGACCTGCGCTCCCTGTGCCTGT
TCTCGTACCACCGCCTGCGCGACTTCCTCCTGCTGGCGGCCCGCGTCGTGGAGCTGCTGGGCCACTCCTCCCTGCGGGGCCTGCA
GCGCGGCTGGGAGGTGCTCAAGTACCTGGGCTCGCTGGTGCAGTACTGGGGCCTGGAGCTGAAGCGGTCCACCATCTCCCTGTTC
GACACCCTCGCCATCGCCGTCGCGGAGGGCACCGACCGCATCATCGAACTCATCCAGGGGTTCTGCCGCGCCATCCGCAACATCC
CCACCCGCATCCGCCAGGGCTTCGAGGCCTCGCTCCTGTAGTAAGgtaaccgggacccgaattcggatcc
```

Figure 3 continued

```
>CH848.3.d1720.5.optBF
gtcgacaagaaATGCGCGTGACGGGCATCCTGAAGAACTGCCCGCTCTGGTGGATCTGGGGCATCCTGGGCTTCTGGATGCTCAT
GAACTGCAACGGCGAGGGCAACCTCTGGGTGACGGTCTACTACGGCGTGCCGGTGTGGAAGGAGGCCAAGACGACCCTGTTCTGC
GCGTCGGACGCCAAGGCCTACGTGAAGGAGGTGCACAACGTGTGGGCGACCCACGCCTGCGTGCCCACGGACCCCTCGCCGCAGG
AGCTGGTCCTGGACAACGTGACCGAGAACTTCAACATGTGGAAGAACGACATGGTGGACCAGATGCACGAGGACATCATCTCCCT
GTGGGACCAGTCCCTGAAGCCCTGCGTGAAGCTGACCCCGCTGTGCGTGACCCTGAACTGCTCGAACGCCATCGTCCGGAACTCC
ACGACCGAGAAGATGTCCGACGCGCTGGACCGCAACTCGACGACCGAGGAGATGAAGAACTGCTCCTTCAACACCACGACGGAGA
TCCGCGACAAGGAGAAGAAGGAGTACGCCCTGTTCTACCGCCCCGACATCGTGCCGCTGAACAACAAGACGTCCAACATCTCCGA
GTACAGGCTGATCAACTGCAACACCTCCACCGTCACGCAGGCGTGCCCCAAGGTCACGTTCGAGCCCATCCCCATCCACTACTGC
GCCCCCGCCGGCTACGCCATCCTGAAGTGCAACAACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGAAGGAGGAGATCGTCATCCGGTCCGA
GAACCTCACGAACAACGCCAAGATCATCATCGTGCAGCTGAACGCGAACGCCTCCGTGGAGATCGTGTGCACCCGCCCGAACAAC
AACACGCGCAAGTCCGTGCGGATCGGCCCTGGCCAGACCTTCTACGCCACCGGCGACATCATCGGCGACATCCGGCAGGCCCACT
GCAACATCTCGGAGAAGAAGTGGAACGAGACCCTGCAGCAGGTGGGCATCGAGCTGCAGAAGCACTTCCCCAACAAGACCATCAA
GTACAACCAGTCCGCCGGCGGCGACATGGAGATCACCACGCACTCCTTCAACTGCGGTGGCGAGTTCTTCTACTGCAACACGGCC
AAGCTGTTCAACTCCACGTACAACGGCACCTACATCTCCACGGACTCGATCAACTCGACCCTCAACATCACGCTCCAGTGCCGGA
TCAAGCAGATCATCAACATGTGGCAGGGGGTGGGCCGCGCTATGTACGCACCGCCCATCGCCGGCAACATCACCTGCCGGTCCAA
CATCACCGGCCTCCTGCTGACCCGCGACGGCGGCATCCACAACGACTCGAACGTGACGGAGACCTTCAGGCCAGCGGGAGGCGAC
ATGCGGGACAACTGGCGCTCCGAGCTGTACAAGTACAAGGTGGTGGAGATCCAGCCCCTGGGCATCGCACCCACCGGGGCCAAGA
GGCGGGTCGTGGGGCGCGAGAAGCGCGCGGCCGGCCTCGGCGCCCTGTTCCTGGGCTTCCTGGGCGCTGCGGGCTCCACCATGGG
TGCCGCGTCCATCACCCTGACCGTGCAGGCCCGCCAGCTGCTCTCCGGCATCGTGCAGCAGCAGTCCAACCTCCTGAGGGCCATC
GAGGCCCAGCAGCACATGCTGCAGCTGACCGTGTGGGGCATCAAGCAGCTGCAGGCCAGGGTGCTCGCGCTCGAGCGCTACCTGA
AGGACCAGCAGCTGCTCGGCATCTGGGGCTGCTCCGGCAAGCTGATCTGCACGACCAACGTGCCCTGGAACACGTCCTGGTCCAA
CAAGTCGGAGACCGACATCTGGGACAACATGACCTGGATGCAGTGGGAGCGCGAGATCTCCAACTACACCGGGACCATCTACAAG
CTCCTCGAGGAGTCCCAGAACCAGCAGGAGCGGAACGAGCAAGACCTGCTCGCGCTGGACTCGTGGAACTCGCTGTGGTCGTGGT
TCAACATCACCAAGTGGCTGTGGTACATCAAGATCTTCATCATGATCGTCGGCGGCCTGATCGGCCTGCGCATCGTGTTCGCCGT
GCTGTCGATCGTGAACCGCGTGCGCCAGGGCTACTCCCCGCTGTCCCTGCAAACGCTGACCCCCAACCCCCGGGAGCCCGACAGG
CTGCGCGGGATCGAGGAGGAGGGCGGCGAGCAGGACCGCGACAAGTCCATCCGCCTGGTGTCCGGCTTCCTGCCCATCGTGTGGG
ACGACCTGCGCTCCCTGTGCCTGTTCTCGTACCACCGCCTGCGCGACTTCCTCCTGCTGGCGGCCCGCGTCGTGGAGCTGCTGGG
CCGGTCCTCCCTGCGGGGCCTGCAGCGCGGCTGGGAGGTGCTCAAGTACCTGGGCTCGCTGGTGCAGTACTGGGGCCTGGAGCTG
AAGAAGTCCGCGATCTCCCTGTTCGACACCCTCGCCATCGCCGTCGCGGAGGGCACCGACCGCATCATCGAAGCGATCCAGGGGT
TCTGCCGCGCCATCCGCAACATCCCCCGGCGCATCCGCCAGGGCTTCGAGGCCTCGCTCCTGTAGTAAgttaccgggacccgaa
ttcggatcc
```

Figure 4

>CH0848.3.TF.hivn (wild type sequence)   (SEQ ID NO: 279)

ATGAGAGTGATGGGGATACTGAAGAATTATCCACAATGGTGGATATGGGGCATCTTAGGCTTTTGGATGCTAATGAT
TTGTAATGGGAAAGGAAACTTGTGGGTCACAGTCTATTATGGGGTACCAGTATGGAAAGAAGCAAAAACTACTCTGT
TTTGTGCATCAGATGCCAAAGCATATGAGAAAGAAGTGCATAATGTCTGGGCTACACATGCCTGTGTACCCACAGAC
CCCAGCCCACAAGAATTGGTTTTGGAAAATGTAACAGAAAATTTTAACATGTGGAAAAATGATATGGTAGATCAGAT
GCATGAGGATATAATCAGTCTATGGGATCAAAGCCTAAAGCCATGTGTAAAGTTGACCCCACTCTGTGTCACTTTAA
ATTGTAGTAATGCTACTGTTGACAGTAGTAAAGTTTATGATACTAGGAGTAATGTTAATGTTACCAGTATCAATAAT
ACCATAATGGGAGAAATGAAAAATTGCTCTTTCAATACAACCACAGAAATAAGAGATAAGGAAAAGAAGGAATATGC
ACTTTTTTATAGACCTGATGTAGTACCACTTGATGAAACAAGCAATACCAGTGAGTATAGATTAATAAATTGTAATA
CCTCAGCCGTAACACAAGCCTGTCCAAAGGTCACTTTTGAACCAATTCCTATACATTATTGTGCTCCAGCTGGTTAT
GCGATTCTAAAGTGTAATAATAAGACATTCAATGGAACAGGACCATGCAGTAATGTCAGCACAGTACAATGTACACA
TGGAATTAGGCCAGTGGTATCAACCCAACTACTGTTAAATGGTAGTCTGGCAGAAAAAGAGATAGTAATTAGATCTG
AAAACCTGACAAACAATGCCAAAATAATAATAGTCCATCTTAACACCTCTGTAGAAATTGTGTGTACAAGGCCCGGC
AATAATACAAGGAAAAGTGTGAGAATAGGACCAGGACAAACATTCTATGCAACAGGAGACATAATAGGAGATATAAG
ACAAGCACATTGTAACATTAGTGAAAGGCAATGGAATAAAACTTTACAAGAGGTAGGTAAAGAATTGCAAAACACT
TCCCTAATAAGACAATAAAGTATGAACGATCCGCAGGAGGAGACATGGAAATTGCAACACATAGCTTTAATTGTGGA
GGAGAATTTTTCTATTGCAATACATCAAATCTGTTTAATGGTACATACAATGGTACATACATAAGTACAAACAGTAC
TTCAAACATCACGCTTCAATGCAGAATAAAACAAATTATAAACATGTGGCAGGGGGTAGGAAGAGCAATGTATGCTC
CTCCCATTGCAGGAAACATAACATGTAAATCAAATATCACAGGGCTACTATTGACACGTGATGGAGGGACCAAAAAT
AATAGCAACGAGACAGAGGAGACATTCAGGCCTGCAGGAGGAGATATGAGGGATAATTGGAGAAGTGAATTATATAA
ATATAAAGTAGTAGAAATTCAGCCATTAGGAATAGCACCAACTGGTGCAAAAAGGAGAGTGGTGGAGAGAGAAAAAA
GAGCAGCAGGACTAGGAGCTTTGTTCCTTGGGTTCTTGGGAGCAGCAGGAAGCACTATGGGCGCAGCATCAATAACG
CTGACGGTACAGGCCAGACAATTGTTGTCTGGTATAGTGCAACAGCAAAGCAATTTGCTGAGGGCTATAGAGGCGCA
ACAGCATATGTTGCAACTCACGGTCTGGGGCATCAAGCAGCTCCAGGCAAGAGTCCTGGCTCTGGAAAGATACCTAA
AGGATCAACAGCTCCTAGGGATGTGGGGCTGCTCTGGAAAACTCATCTGCACCACTGCTGTGCCTTGGAACACTAGT
TGGAGTAATAAATCTGAAAAGGATATTTGGGATAACATGACATGGATGCAGTGGGAGAGAGAAATTAGCAATTACAC
AGAGACAATATACATGTTGCTTGAAGACTCGCAACACCAGCAGGAAAGAAATGAAAAAGATTTACTAGCATTGGACA
GTTGGAACAGTCTGTGGAATTGGTTTAACATAACAAACTGGCTGTGGTATATAAGAATATTCATAATGATAGTAGGG
GGCTTGATAGGTTTAAGAATAGTTTTTGCTGTGCTATCTATAGTGAATAGAGTCAGGCAGGGATACTCACCTTTGTC
GTTGCAGACCCTTACCCCAAACCCGAGGGAACCCGACAGGCTCAGAGGAATCGAAGAAGAAGGTGGAGAGCAAGACA
GAGACAGATCCATTCGATTAGTGAGCGGATTCTTGCCAATTGTCTGGGACGACCTGCGGAGCCTGTGCCTCTTCAGT
TACCACCGATTGAGAGACTTTCTATTGCTGGCAGCGAGAGTGGTGGAACTTCTGGGACGCAGCAGTCTCAGGGGACT
GCAGAGGGGTGGGAAGTCCTTAAGTATCTGGGAAGTCTTGTGCAGTATTGGGGTCTGGAACTAAAAAAGAGTGCTA
TTAGTCTTTTTGATACCATAGCAATAGCAGTAGCTGAAGGAACAGATAGGATTATAGAAGTAATACAAAGATTTTGT
AGAGCTATCCGCAACATACCTACAAGAATAAGACAAGGCTTTGAAGCATCTTTGCTATAA

Figure 4 continued

>CH0848.3.TF gp160 (SEQ ID NO: 280)

MRVMGILKNYPQWWIWGILGFWMLMICN*GKGNLWVTVYYG*VPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAK*R*RVVEREK*R*AAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR<u>IFIMIVG
GLIGLRIVFAVLSIVNRVRQGYSPLSLQTLTPNPREPDRLRGIEEEGGEQDRDRSIRLVSGFLPIVWDDLRSLCLFS
YHRLRDFLLLAARVVELLGRSSLRGLQRGWEVLKYLGSLVQYWGLELKKSAISLFDTIAIAVAEGTDRIIEVIQRFC
RAIRNIPTRIRQGFEASLL</u>

Example of gp140C and delta 11 deletion gp120 (D11gp120) designs:

For gp140C:

Residues in the gp160 sequence above underlined (green blue) will be deleted and the underlined "R" highlighted in red will be deleted for production of gp140C.

For gp120:

Residues in the gp160 sequence above highlighted in <u>underlined</u> and *italicized* (blue) will be deleted and the "R" <u>underlined</u> and *italicized* (highlighted in red) will be deleted for production of gp120 with delta 11 deletion design (D11gp120).

The amino acid residues for the D11gp120 design can be shorter or loner depending on the wild-type sequences.

Figure 4 continued

>CH0848.3.TFgp140C (SEQ ID NO: 281)

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR

>HV130048́6, CH0848.3.TFgp140C.opt (SEQ ID NO: 282) and (SEQ ID NO: 283, the
coding sequence which is in capital letters)

aagcttgtcgacaccATGCGCGTGATGGGCATCCTGAAGAACTACCCCCAGTGGTGGATCTGGGGCATCCTGGGCTT
CTGGATGCTGATGATCTGCAACGGCAAGGGCAACCTGTGGGTGACCGTGTACTACGGCGTGCCCGTGTGGAAGGAGG
CCAAGACCACCCTGTTCTGCGCCTCCGACGCCAAGGCCTACGAGAAGGAGGTGCACAACGTGTGGGCCACCCACGCC
TGCGTGCCCACCGACCCCTCCCCCCAGGAGCTGGTGCTGGAGAACGTGACCGAGAACTTCAACATGTGGAAGAACGA
CATGGTGGACCAGATGCACGAGGACATCATCTCCCTGTGGGACCAGTCCCTGAAGCCCTGCGTGAAGCTGACCCCCC
TGTGCGTGACCCTGAACTGCTCCAACGCCACCGTGGACTCCTCCAAGGTGTACGACACCCGCTCCAACGTGAACGTG
ACCTCCATCAACAACACCATCATGGGCGAGATGAAGAACTGCTCCTTCAACACCACCACCGAGATCCGCGACAAGGA
GAAGAAGGAGTACGCCCTGTTCTACCGCCCCGACGTGGTGCCCCTGGACGAGACCTCCAACACCTCCGAGTACCGCC
TGATCAACTGCAACACCTCCGCCGTGACCCAGGCCTGCCCCAAGGTGACCTTCGAGCCCATCCCCATCCACTACTGC
GCCCCCGCCGGCTACGCCATCCTGAAGTGCAACAACAAGACCTTCAACGGCACCGGCCCCTGCTCCAACGTGTCCAC
CGTGCAGTGCACCCACGGCATCCGCCCCGTGGTGTCCACCCAGCTGCTGCTGAACGGCTCCCTGGCCGAGAAGGAGA
TCGTGATCCGCTCCGAGAACCTGACCAACAACGCCAAGATCATCATCGTGCACCTGAACACCTCCGTGGAGATCGTG
TGCACCCGCCCCGGCAACAACACCCGCAAGTCCGTGCGCATCGGCCCCGGCCAGACCTTCTACGCCACCGGCGACAT
CATCGGCGACATCCGCCAGGCCCACTGCAACATCTCCGAGCGCCAGTGGAACAAGACCCTGCAGGAGGTGGGCAAGG
AGCTGCAGAAGCACTTCCCCAACAAGACCATCAAGTACGAGCGCTCCGCCGGCGGCGACATGGAGATCGCCACCCAC
TCCTTCAACTGCGGCGGCGAGTTCTTCTACTGCAACACCTCCAACCTGTTCAACGGCACCTACAACGGCACCTACAT
CTCCACCAACTCCACCTCCAACATCACCCTGCAGTGCCGCATCAAGCAGATCATCAACATGTGGCAGGGCGTGGGCC
GCGCCATGTACGCCCCCCCCATCGCCGGCAACATCACCTGCAAGTCCAACATCACCGGCCTGCTGCTGACCCGCGAC
GGCGGCACCAAGAACAACTCCAACGAGACCGAGGAGACCTTCCGCCCCGCCGGCGGCGACATGCGCGACAACTGGCG
CTCCGAGCTGTACAAGTACAAGGTGGTGGAGATCCAGCCCCTGGGCATCGCCCCCACCGGCGCCAAGGAGCGCGTGG
TGGAGCGCGAGAAGGAGGCCGCCGGCCTGGGCGCCCTGTTCCTGGGCTTCCTGGGCGCCGCCGGCTCCACCATGGGC
GCCGCCTCCATCACCCTGACCGTGCAGGCCCGCCAGCTGCTGTCCGGCATCGTGCAGCAGCAGTCCAACCTGCTGCG
CGCCATCGAGGCCCAGCAGCACATGCTGCAGCTGACCGTGTGGGGCATCAAGCAGCTGCAGGCCCGCGTGCTGGCCC
TGGAGCGCTACCTGAAGGACCAGCAGCTGCTGGGCATGTGGGGCTGCTCCGGCAAGCTGATCTGCACCACCGCCGTG
CCCTGGAACACCTCCTGGTCCAACAAGTCCGAGAAGGACATCTGGGACAACATGACCTGGATGCAGTGGGAGCGCGA
GATCTCCAACTACACCGAGACCATCTACATGCTGCTGGAGGACTCCCAGCACCAGCAGGAGCGCAACGAGAAGGACC
TGCTGGCCCTGGACTCCTGGAACTCCCTGTGGAACTGGTTCAACATCACCAACTGGCTGTGGTACATCCGCTAGgga
tcctctaga

Figure 4 continued

>CH0848.3.TFD11gp120 (SEQ ID NO: 284)

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE

>HV1300487, CH0848.3.TFD11gp120.opt (SEQ ID NO: 285) and (SEQ ID NO: 286, the
coding sequence which is in capital letters)

aagcttgtcgacaccATGCGCGTGATGGGCATCCTGAAGAACTACCCCCAGTGGTGGATCTGGGGCATCCTGGGCTT
CTGGATGCTGATGATCTGCAACGGCGTGCCCGTGTGGAAGGAGGCCAAGACCACCCTGTTCTGCGCCTCCGACGCCA
AGGCCTACGAGAAGGAGGTGCACAACGTGTGGGCCACCCACGCCTGCGTGCCCACCGACCCCTCCCCCCAGGAGCTG
GTGCTGGAGAACGTGACCGAGAACTTCAACATGTGGAAGAACGACATGGTGGACCAGATGCACGAGGACATCATCTC
CCTGTGGGACCAGTCCCTGAAGCCCTGCGTGAAGCTGACCCCCCTGTGCGTGACCCTGAACTGCTCCAACGCCACCG
TGGACTCCTCCAAGGTGTACGACACCCGCTCCAACGTGAACGTGACCTCCATCAACAACACCATCATGGGCGAGATG
AAGAACTGCTCCTTCAACACCACCACCGAGATCCGCGACAAGGAGAAGAAGGAGTACGCCCTGTTCTACCGCCCCGA
CGTGGTGCCCCTGGACGAGACCTCCAACACCTCCGAGTACCGCCTGATCAACTGCAACACCTCCGCCGTGACCCAGG
CCTGCCCCAAGGTGACCTTCGAGCCCATCCCCATCCACTACTGCGCCCCCGCCGGCTACGCCATCCTGAAGTGCAAC
AACAAGACCTTCAACGGCACCGGCCCCTGCTCCAACGTGTCCACCGTGCAGTGCACCCACGGCATCCGCCCCGTGGT
GTCCACCCAGCTGCTGCTGAACGGCTCCCTGGCCGAGAAGGAGATCGTGATCCGCTCCGAGAACCTGACCAACAACG
CCAAGATCATCATCGTGCACCTGAACACCTCCGTGGAGATCGTGTGCACCCGCCCCGGCAACAACACCCGCAAGTCC
GTGCGCATCGGCCCCGGCCAGACCTTCTACGCCACCGGCGACATCATCGGCGACATCCGCCAGGCCCACTGCAACAT
CTCCGAGCGCCAGTGGAACAAGACCCTGCAGGAGGTGGGCAAGGAGCTGCAGAAGCACTTCCCCAACAAGACCATCA
AGTACGAGCGCTCCGCCGGCGGCGACATGGAGATCGCCACCCACTCCTTCAACTGCGGCGGCGAGTTCTTCTACTGC
AACACCTCCAACCTGTTCAACGGCACCTACAACGGCACCTACATCTCCACCAACTCCACCTCCAACATCACCCTGCA
GTGCCGCATCAAGCAGATCATCAACATGTGGCAGGGCGTGGGCCGCGCCATGTACGCCCCCCCCATCGCCGGCAACA
TCACCTGCAAGTCCAACATCACCGGCCTGCTGCTGACCCGCGACGGCGGCACCAAGAACAACTCCAACGAGACCGAG
GAGACCTTCCGCCCCGCCGGCGGCGACATGCGCGACAACTGGCGCTCCGAGCTGTACAAGTACAAGGTGGTGGAGAT
CCAGCCCCTGGGCATCGCCCCCACCGGCGCCAAGGAGCGCGTGGTGGAGCGCGAGAAGGAGTAGggatcctctaga

Figure 5 (DNA sequence of CH848D11gp120 constructs:

>HV1300892_CH848.3.d0078.30.02D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACAAGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAAGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGCACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGggatcc
>HV1300893_CH848.3.d0078.30.42D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGAACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcgggacccggatc
c
>HV1300894_CH848.3.d0107.30.12D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC

Figure 5 continued
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCGCCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtcaccgaattcgggacccggatc
c
>HV1300895_CH848.3.d0107.30.27D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAAGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtaaccgaattcgggacccggatc
c
>HV1300896_CH848.3.d0107.30.31D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGTCCAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCGCCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgttaccgaattcgggacccggatc
c
>HV1300897_CH848.3.d0135.27.03D11gp120

Figure 5 continued

```
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcgggtcccggatc
c
>HV1300898_CH848.3.d0135.27.06D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGGCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAAGTGCAGCAACGCCATCGTGGACTCCAGCAAGGTGTACGA
CACGAGGTCCAAGGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGGGATCG
TCATCCGGTCCGAGAACCTCACGAACAACGCGAAGATCATCATCGTGCAGCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTGGCAGTGGAACAAGACCCTGCACGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAACACCTCGTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcaggacccggatc
c
>HV1300899_CH848.3.d0135.60.05D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTCGCAGTGGAACAAGACCCTGCAGGAGGTGGGCAAGGAGCTGCAGAAGCACTTCC
```

Figure 5 continued

CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcaggtcccggatc
c
>HV1300900_CH848.3.d0135.60.14D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACCAACTCCACGAGCAACATCACG
CTCCAGTGCCGCATCAAGCAGATCATCAACATGTGGCAGGGGGTGGGCCGCGCTATGTACGCACCGCCCATCGCCGGCCACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcgggacctggatc
c
>HV1300901_CH848.3.d0135.60.19D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACAAGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTCGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACCAACTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtgaccgaattcgggtcctggatc
c
>HV1300902_CH848.3.d0135.60.20D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA

Figure 5 continued

CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAAGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCAACAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtcaccgaattcgggtcccggatc
c
>HV1300903_CH848.3.d0135.60.32D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCACCAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtcaccgaattcaggacccggatc
c
>HV1300904_CH848.3.d0135.60.34D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCAACAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG

Figure 5 continued

GGCATCGCACCCACCGGGGCCAAGgagCGGGTCGTGGAGCGCGAGAAGgagTAGTAAGgtcaccgaattcaggtcccggatc
c
>HV1300905_CH848.3.d0194.25.17D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGATCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGTCCGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCTCGACCAACTCGACG
AGCAACATCACGCTCCAGTGCCGCATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCACCAAGAACAACAGCAACGA
GACGGAGGAGACCTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGgagCGGGTCGTGGAGCGCGAGAAGgagTAGTAAGgtcaccgaattc
gggacctggatcc
>HV1300906_CH848.3.d0194.25.21D11gp120
GgtcgacaagaaGCCACCATGAAGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAACGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAGCACGAACTCCACCAGCTCGATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtcaccgaattcgggtcctggatc
c
>HV1300907_CH848.3.d0194.25.24D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG

Figure 5 continued

```
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTCCCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAACACGTCGTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtaaccgaattcgggtcccggatc
c
>HV1300908_CH848.3.d0194.25.48D11gp120
GgtcgacaagaaGCCACCATGCGCGTGATGGGCATCCCGAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCATCGTGGACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTGGCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAACACGTCGTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCCGCgagCGGGTCGTGGAGCGCGAGAAGgagTAGTAAGgtaaccgaattcaggacccggatc
c
>HV1300909_CH848.3.d0274.30.02D11gp120
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGAACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGTGGCAGTGGAACAAGACCCTGCACGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAACACGTCGTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtaaccgaattcaggtcccggatc
c
>HV1300910_CH848.3.d0274.30.07D11gp120
GgtcgacaagaaGCCACCATGCGCGTGATGGGCATCCCCAAGAACTACCCGCAGTGGTGGATCTGGGGCATCCTGGGCTTCT
GGATACTCATGATCTGCAACggcgtgCCGGTGTGGAAGGAGGCCAAGACGACCCTGTTCTGCGCGTCGGACGCCAAGGCCTA
```

Figure 5 continued

```
CGAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAACAGCGCCACCGTGGACAACAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACAAGCCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACGACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGGCCAGTGGAACAAGACCCTGCACGAGGTGTCCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCAACACGTCGTCCACGAGCAACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgtaaccgaattcgggacctggatc
c
>HV1300911_CH848.3.d0274.30.09D11gp120
GgtcgacaagaaGCCACCATGCGCGTGCGGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGATCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCACCGTGAACTCCAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGTCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGCCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGCCAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCTCGACGAACTCCTCCACCAACTCGACG
AGCAACATCACGCTCCAGTGCCGCATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCACCAAGAACAACAGCAACGA
GACGGAGGAGACCTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGgagCGGGTCGTGGAGCGCGAGAAGgagTAGTAAGgtaaccgaattc
gggtcctggatcc
>HV1300912_CH848.3.d0274.30.14D11gp120
GgtcgacaagaaGCCACCATGCGCGTGATGGGCATCCTCAAGAACTACCTGCAGTGGTGGATCTGGGGCATCCTGGGCTTCT
GGATGCTCATGATCTGCAAGggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGAGAAC
GTGATCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGACCTGCAGCAACGCCACCGTGGACAACAGCAAGGTGTACGA
CACGAGGTCCAACGTGAACGTCACGAGCATCAACAACACGATCATGGGCGAGATGAAGAACTGCTCCTTCAACACGACGACG
GAGATCCGCGACAAGGAGAAGAAGGAGTACGCCCTGTTCTACCGGTCGGACGTCGTGCCGCTGGACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACAAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGTCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGCGCCAGTGGTACAAGACCCTGCAGGAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCTCGATCAACTCCACGAGCTACATCACG
```

Figure 5 continued

```
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAAGAACAACAGCAACGAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGgttaccgaattcgggtcccggatc
c
>HV1300913_CH848.3.d0358.80.03D11gp120
GgtcgacaagaaGCCACCATGAAGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGGGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCAGGTCCAACGTGAACGTCACGAGCAT
CAACAACACGATCATGGGCGAGATGAAGAACTGCTCCTTCAACACGACGACGGAGATCCGCGACAAGGAGAAGAAGGAGTAC
GCCCTGTTCTACAAGCCCGACGTCGTGCCGCTGAACGAGACCAGCAACACCTCGGAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACAACGAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCCGAGAAGGAGATCGTCATCCGGTCCGAGAACCTCACGAACAACG
CGAAGATCATCATCGTGCACCTGAACACGCCGGTGGAGATCGTGTGCACCCGCCCGGGCAACAACACGCGCAAGTCCGTCCG
GATCGGCCCTGGCCAGACCTTCTACGCCACCGGCGACATCATCGGCGACATCCGCCAGGCCCACTGCAACATCAGCGAGGGG
CAGTGGAACAAGACCCTGCAGGAGGTGGGCAAGGAGCTGCAGAAGCACTTCCCCAACAAGACGATTAAGTACGAGCGGTCGG
CCGGCGGCGACATGGAGATCACCACGCACTCCTTCAACTGCGGTGGCGAGTTCTTCTACTGCAACACGTCGAACCTGTTCAA
CGGCACCTACAACGGCACCTACATCAACATCTCCACCAACTCCAACAGCACGATCACGCTCCAGTGCCGCATCAAGCAGATC
ATCAACATGTGGCAGGGGGTGGGCCGCGCTATGTACGCACCGCCCATCGCCGGCAACATCACCTGCAAGTCCAACATCACCG
GCCTCCTGCTGACCCGCGACGGCGGCACCAAGAACAACAGCAACGAGGAGACCTTCAGGCCAGCGGGAGGCGACATGCGCGA
CAACTGGCGCTCCGAGCTGTACAAGTACAAGGTGGTGGAGATCCAGCCCCTGGGCATCGCACCCACCGGGGCCAAGgagCGG
GTCGTGGAGCGCGAGAAGgagTAGTAAGgttaccgaattcaggacccggatcc
>HV1300914_CH848.3.d0358.80.06D11gp120
GgtcgacaagaaGCCACCATGCGGGTGATGGGCATCCCCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCAGGTCCAACGTGAACGTCACGAGCAT
CAACAACACGATCATGGGCGAGATGAAGAACTGCTCCTTCAACACGACGACGGAGATCCGCGACAAGGAGAAGAAGGAGTAC
GCCCTGTTCTACAAGCCCGACGTCGTGCCGCTGAACGAGACCAGCAACACCTCGGAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACAACAAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCCGAGAAGGAGATCGTCATCCGGTCCGAGAACCTCACGAACAACG
CGAAGATCATCATCGTGCACCTGAACACGCGGTGGAGATCGTGTGCACCCGCCCGGGCAACAACACGCGCAAGTCCGTCCG
GATCGGCCCTGGCCAGACCTTCTACGCCACCGGCGACATCATCGGCGACATCCGCCAGGCCCACTGCAACATCAGCGAGGGG
CAGTGGAACAAGACCCTGCACGAGGTGTCCAAGGAGCTGCAGAAGCACTTCCCCAACAAGACGATTAAGTACGAGCGGTCGG
CCGGCGGCGACATGGAGATCGCCACGCACTCCTTCAACTGCGGTGGCGAGTTCTTCTACTGCAACACGTCGAACCTGTTCAA
CGGCACCTACAACGGCACCTACATCAACACGTCCTCCACCAGCTACATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCAACATCACCGGCCTCC
TGCTGACCCGCGACGGCGGCACCAAGAACAACAGCAACGAGGAGACCTTCAGGCCAGCGGGAGGCGACATGCGCGACAACTG
GCGCTCCGAGCTGTACAAGTACAAGGTGGTGGAGATCCAGCCCCTGGGCATCGCACCCACCGGGGCCAAGgagCGGGTCGTG
GAGCGCGAGAAGgagTAGTAAGgttaccgaattcaggtcccggatcc
>HV1300915_CH848.3.d0358.80.17D11gp120
GgtcgacaagaaGCCACCATGCGGGTGATGGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCAGGTCCAACGTGAACGTCACGAGCAT
CAACAACACGATCATGGGCGAGATGAAGAACTGCTCCTTCAACACGACGACGGAGATCCGCGACAAGGAGAAGAAGGAGTAC
GCCCTGTTCTACCGGCCCGACGTCGTGCCGCTGAACGAGACCAGCAACACCTCGGAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACAACGAGACCTTCAACGGGACCGGCCCGTGCAGCAACGTGTCCACCGTGCAGTGCACGCACGGCATCCGGCCC
```

Figure 5 continued

```
GTGGTGTCCACGCAGCTGCTCCTGAACGGGTCGCTGGCCGAGAAGGAGATCGTCATCCGGTCCGAGAACCTCACGAACAACG
CGAAGATCATCATCGTGCACCTGAACACGTCGGTGGAGATCGTGTGCACCCGCCCGGGCAACAACACGCGCAAGTCCGTCCG
GATCGGCCCTGGCCAGACCTTCTACGCCACCGGCGACATCATCGGCGACATCCGCCAGGCCCACTGCAACATCAGCGAGGAG
AAGTGGAACAAGACCCTGCAGCAGGTGGGCAAGGAGCTGCAGAAGCACTTCCCCAACAAGACGATTAAGTACGAGCGGTCGG
CCGGCGGCGACATGGAGATCACCACGCACTCCTTCAACTGCGGTGGCGAGTTCTTCTACTGCAACACGTCGAACCTGTTCAA
CGGCACCTACAACGGCACCTACATCAACATCTCCACCAACTCCAACAGCACGATCACGCTCCAGTGCCGCATCAAGCAGATC
ATCAACATGTGGCAGGGGGTGGGCCGCGCTATGTACGCACCGCCCATCGCCGGCAACATCACCTGCAAGTCCAACATCACCG
GCCTCCTGCTGACCCGCGACGGCGGCACCAAGAACAACAGCAACGAGGAGACCTTCAGGCCAGCGGGAGGCGACATGCGCGA
CAACTGGCGCTCCGAGCTGTACAAGTACAAGGTGGTGGAGATCCAGCCCCTGGGCATCGCACCCACCGGGGCCAAGgagCGG
GTCGTGGAGCGCGAGAAGgagTAGTAAGgttaccgaattcgggacctggatcc
>HV1300916_CH848.3.d0358.80.44D11gp120
GgtcgacaagaaGCCACCATGCGGGTGATGGGCATCCTCAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGGGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGCCAGGTCCAACGTGAACGTCACGAGCAT
CAACAACACGATCATGGGCGAGATGAAGAACTGCTCCTTCAACACGACGACGGAGATCCGCGACAAGGAGAAGAAGGAGTAC
GCCCTGTTCTACAAGCCCGACGTCGTGCCGCTGAACGAGACCAGCAACACCTCGGAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACAACAAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCCGAGAAGGAGATCGTCATCCGGTCCGAGAACCTCACGAACAACG
CGAAGATCATCATCGTGCACCTGAACACGTCGGTGGAGATCGTGTGCACCCGCCCGGGCAACAACACGCGCAAGTCCGTCCG
GATCGGCCCTGGCCAGACCTTCTACGCCACCGGCGACATCATCGGCGACATCCGCCAGGCCCACTGCAACATCAGCGAGGAG
AAGTGGAACAAGACCCTGCAGGAGGTGGGCAAGGAGCTGCAGAAGCACTTCCCCAACAAGACGATTAAGTACGAGCGGTCGG
CCGGCGGCGACATGGAGATCGCCACGCACTCCTTCAACTGCGGTGGCGAGTTCTTCTACTGCAACACGTCGAACCTGTTCAA
CGGCACCTACAACGGCACCGACATCTCCACCAACTCCAACAGCACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCAACATCACCGGCCTCC
TGCTGACCCGCGACGGCGGCACCAAGAACAACAGCAACGAGGAGACCTTCAGGCCAGCGGGAGGCGACATGCGCGACAACTG
GCGCTCCGAGCTGTACAAGTACAAGGTGGTGGAGATCCAGCCCCTGGGCATCGCACCCACCGGGGCCAAGgagCGGGTCGTG
GAGCGCGAGAAGgagTAGTAAGgttaccgaattcgggtcctggatcc
>HV1300917_CH848.3.d0445.25.04D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCAGCAACGTCAACGTGGTGAACGTCACGAACATCAC
GAACACGATCAAGGGCGAGATGAAGAACTGCTCCTTCAACACGACGACGGAGATCCGCGACAAGGAGAAGAAGGAGTACGCC
CTGTTCTACCGGCCCGACGTCGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCCGAGAAGGGGATCGTCATCCGGTCCGAGAACCTCACGAACAACGCGA
AGATCATCATCGTGCAGCTGAACACGTCGGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGGAGAAG
TGGAACAAGACCCTGCACGAGGTGTCGAAGGAGCTGCAGAAGCACTTCCCCAACAAGACGATTAAGTACGAGCGGTCGGCCG
GCGGCGACATGGAGATCGCCACGCACTCCTTCAACTGCGGTGGCGAGTTCTTCTACTGCAACACGTCGAAGCTGTTCAACGG
CACCTACAACGGCACCTACATCTCCACCAACTCCACCAGCTACATCACGCTCCAGTGCCGCATCAAGCAGATCATCAACATG
TGGCAGGGGGTGGGCCGCGCTATGTACGCACCGCCCATCGCCGGCAACATCACCTGCAAGTCCAACATCACCGGCCTCCTGC
TGACCCGCGACGGCGGCACCAACAACAACAGCAACGAGGAGACCTTCAGGCCAGCGGGAGGCGACATGCGCGACAACTGGCG
CTCCGAGCTGTACAAGTACAAGGTGGTGGAGATCCAGCCCCTGGGCATCGCACCCACCGGGGCCAAGgagCGGGTCGTGGAG
CGCGAGAAGgagTAGTAAGggacccgaattcggtgaccggatcc
>HV1300918_CH848.3.d0445.25.18D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
```

Figure 5 continued

```
TGAAGCCCTGCGTGAAGCTGACCCCGCTGTGCGTGACCCTGAACTGCAGCAACGTCAACGTGGTGAACGTCACGAACATCAC
GAACACGATCAAGGGCGAGATGAAGAACTGCTCCTTCAACACGACGACGGAGATCCGCGACAAGGAGAAGAAGGAGTACGCC
CTGTTCTACCGGCCCGACGTCGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCCGAGAAGGAGATCGTCATCCGGTCCGAGAACCTCACGAACAACGCGA
AGATCATCATCGTGCACCTGCACACGCCCGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGGAGAAG
TGGAACAAGACCCTGCAGGAGGTGGGCAAGGAGCTGCAGAAGCACTTCCCCAACAAGACGATTAAGTACGAGCGGTCGGCCG
GCGGCGACATGGAGATCACCACGCACTCCTTCAACTGCGGTGGCGAGTTCTTCTACTGCAACACGTCGAACCTGTTCAACGG
CACCTACAACGGCCCGTACATCAACATCTCCACCAACTCCAACAGCACCATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACCGGCC
TCCTGCTGACCCGCGACGGCGGCACCAAGAACAACAGCAACGAGGAGACCTTCAGGCCAGCGGGAGGCGACATGCGCGACAA
CTGGCGCTCCGAGCTGTACAAGTACAAGGTGGTGGAGATCCAGCCCCTGGGCATCGCACCCACCGGGGCCAAGgagCGGGTC
GTGGAGCGCGAGAAGgagTAGTAAGggacccgaattcggtcaccggatcc
>HV1300919_CH848.3.d0445.25.26D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGGACTGCTCGAACGTGAACGTCGTGAACGTCACGAACATCAC
CAACACGATCAAGGGCGAGATGAAGAACTGCTCCTTCAACACGACGACGGAGATCCGCGACAAGGAGAAGAAGGAGTACGCC
CTGTTCTACCGGCCCGACGTCGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCCGAGAAGGAGATCGTCATCCGGTCCGAGAACCTCACGAACAACGCGA
AGATCATCATCGTGCACCTGAACACGCCGGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGAAGCAG
TGGAACGAGACCCTGCAGAAGGTGGGCAAGGAGCTGCAGAAGCACTTCCCCAACAAGACGATTAAGTACGAGCGGTCGGCCG
GCGGCGACATGGAGATCACCACGCACTCCTTCAACTGCGGTGGCGAGTTCTTCTACTGCAACACGTCGAACCTGTTCAACGG
CACCTACAACGGCACCTACATCAACATCTCCACCAACTCCAACAGCACGATCACGCTCCAGTGCCGCATCAAGCAGATCATC
AACATGTGGCAGGGGGTGGGCCGCGCTATGTACGCACCGCCCATCGCCGGCAACATCACCTGCCGGTCCAACATCACCGGCC
TCCTGCTGACCCGCGACGGCGACCACCAAGAACAACAGCAACGAGGAGACCTTCAGGCCAGCGGGAGGCGACATGCGCGACAA
CTGGCGCTCCGAGCTGTACAAGTACAAGGTGGTGGAGATCCAGCCCCTGGGCATCGCACCCACCGGGGCCAAGgagCGGGTC
GTGGAGCGCGAGAAGgagTAGTAAGggacccgaattcggtaaccggatcc
>HV1300920_CH848.3.d0445.30.41D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGATGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGTGTCCAACGTGAACGTCACGAACATCAC
GAACACGATCAAGGGCGAGATGAAGAACTGCTCCTTCAACACGACGACGGAGATCCGCGACAAGGAGAAGAAGGAGTACGCC
CTGTTCTACCGGCCCGACGTCGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCGGAGAAGGAGATCGTCATCCGGTCCGAGAACCTCACGAACAACGCGA
AGATCATCATCGTGCACCTGAACACGTCGGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGGAGAAG
TGGAACAAGACCCTGCAGCAGGTGGGCAAGGAGCTGCAGAAGCACTTCCCCAACAAGACGATTAAGTACGAGCGGTCGGCCG
GCGGCGACATGGAGATCGCCACGCACTCCTTCAACTGCGGTGGCGAGTTCTTCTACTGCAACACGTCGAACCTGTTCAACGG
CACCTACAACGGCACCTACTCCACCAACTCCACCAGCACGATCACGCTCCAGTGCCGCATCAAGCAGATCATCAACATGTGG
CAGGGGGTGGGCCGCGCTATGTACGCACCGCCCATCGCCGGCAACATCACCTGCAAGTCCAACATCACCGGCTCCTGCTGA
CCCGCGACGGCGGCACCAAGAACAACAGCAACGAGGAGACCTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGggacccgaattcggttaccggatcc
```

Figure 5 continued

\>HV1300921_CH848.3.d0445.30.42D11gp120
GgtcgacaagaaGCCACCATGCGGGTGATGGGCATCCTCAAGAACTACCCGCCGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCCGGGCCTA
CGAGAAGGAGGTGCACAACGTGTGGGCGACCCACGCCTGCGTGCCCACGGACCCCAGCCCGCAGGAGCTCGTGCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGTGAACGTGGTGAACGTCACGAACATCAC
GAACACGATCAAGGGCGAGATGAAGAACTGCTCCTTCAACACGACGACGGAGATCCGCGACAAGGAGAAGAAGGAGTACGCC
CTGTTCTACAAGCCCGACGTCGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCGGAGAAGGAGATCGTCATCCGGTCCGAGAACCTCACGAACAACGCGA
AGATCATCATCGTGCACCTGAACACGTCGGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGGAGAAG
TGGAACAAGACCCTGCACGAGGTGTCCAAGGAGCTGCAGAAGCACTTCCCCAACAAGACGATTAAGTACGAGCGGTCGGCCG
GCGGCGACATGGAGATCGCCACGCACTCCTTCAACTGCGGTGGCGAGTTCTTCTACTGCAACACGTCGAACCTGTTCAACGG
CACCTACAACGGCACCTACATCTCGACCAACTCGTCCGCGAACTCCAACAGCACGATCACGCTCCAGTGCCGCATCAAGCAG
ATCATCAACATGTGGCAGGGGGTGGGCCGCGCTATGTACGCACCGCCCATCGCCGGCAACATCACCTGCAAGTCCAACATCA
CCGGCCTCCTGCTGACCCGCGACGGCGGCACCAAGAACAACAGCAACGAGGAGACCTTCAGGCCAGCGGGAGGCGACATGCG
CGACAACTGGCGCTCCGAGCTGTACAAGTACAAGGTGGTGGAGATCCAGCCCCTGGGCATCGCACCCACCGGGGCCAAGgag
CGGGTCGTGGAGCGCGAGAAGgagTAGTAAGggtcccgaattcggtgaccggatcc \>HV1300922_CH848.3.d0526.25.02D11gp120
GgtcgacaagaaGCCACCATGAAGGTGATGGGCATCCTCAAGAACTACCCGCAGTGGTGGATCTGGGGCATCCTGGGCTTCT
GGATGCTCATGATCTGCAAGggcgtgCCGGTGTGGAAGGAGGCCAAGACGACCCTGTTCTGCGCGTCGGACGCCCGCGCCTA
CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGCCTACGA
CACGCGCTCCAACGTGAACGTCACGTCCATCAACAACACGATCATGGGCGAGATGAAGAACTGCTCCTTCAACACGACGACG
GAGATCCGCGACAAGGAGAAGAAGGAGTACGCCCTGTTCTACAAGCCCGACATCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGAACACGTCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAAGCAGTGGAACGAGACCCTGCAGAAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAAGCTGTTCAACGGCACCTACAACGGCACCGACATCAACATCTCCACGAACTCCAACAGCACG
ATCACGCTCCAGTGCCGCATCAAGCAGATCATCAACATGTGGCAGGGGGTGGGCCGCGCTATGTACGCACCGCCCATCGCCG
GCAACATCACCTGCAAGTCCAACATCACCGGCCTCCTGCTGACCCGCGACGGCGGCACCAACTCCAACAAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGggacccgaattcggtgaccggat
cc \>HV1300923_CH848.3.d0526.25.09D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCCGCGCCTA
CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGTCAACGTGACCGGGTCCAACGTGAACGT
CACGAACATCACGAACACGATCACCGGCGAGATGAAGAACTGCTCCTTCAACACGACGACGGAGATCCGCGACAAGGAGAAG
AAGGAGTACGCCCTGTTCTACAAGCCCGACGTGGTGCCGCTGAACGAGACCAGCAACACCTCGGAGTACAGGCTGATCAACT
GCAACACCTCCGCGGTCACGCAGGCGTGCCCCAAGGTCACGTTCGAGCCCATCCCCATCCACTACTGCGCCCCGCCGGCTA
CGCCATCCTGAAGTGCAACAACGAGACCTTCAACGGGACCGGCCCGTGCAGCAACGTGTCCACCGTGCAGTGCACGCACGGC
ATCCGGCCCGTGGTGTCCACGCAGCTGCTCCTGAACGGGTCGCTGGCGGAGAAGGGGATCGTCATCCGGTCCGAGAACCTCA
CGAACAACGCGAAGATCATCATCGTGCAGCTGAACACGTCGGTGGAGATCGTGTGCACCCGCCCGGGCAACAACACGCGCAA
GTCCGTCCGGATCGGCCCTGGCCAGACCTTCTACGCCACCGGCGGCATCATCGGCGACATCCGCCAGGCCCACTGCAACATC
AGCGAGTCGAAGTGGAACGAGACCCTGCACGAGGTGTCCAAGGAGCTGCAGAAGCACTTCCCCAACAAGACGATTAAGTACG

Figure 5 continued

```
AGCGGTCGGCCGGCGGCGACATGGAGATCACCACGCACTCCTTCAACTGCGGTGGCGAGTTCTTCTACTGCAACACGTCGAA
CCTGTTCAACGGCACCTACAACGGCACCTACAACGGGACGAACTCCAACAGCACGATCACGCTCCAGTGCCGCATCAAGCAG
ATCATCAACATGTGGCAGGGGGTGGGCCGCGCTATGTACGCACCGCCCATCGCCGGCAACATCACCTGCCGGTCCAACATCA
CCGGCCTCCTGCTGACCCGCGACGGCGGCACCAACTCCAACAAGACGGAGGAGACCTTCAGGCCAGCGGGAGGCGACATGCG
CGACAACTGGCGCTCCGAGCTGTACAAGTACAAGGTGGTGGAGATCCAGCCCCTGGGCATCGCACCCACCGGGGCCAAGgag
CGGGTCGTGGAGCGCGAGAAGgagTAGTAAGaggtcccgaattcggtgaccggatcc
>HV1300924_CH848.3.d0526.25.10D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGTCAACGTGGTGAACGTCACGAACATCAC
GAACACGATCAAGGGCGAGATGAAGAACTGCTCCTTCAACACGACGACGGAGATCCGCGACAAGGAGAAGAAGGAGTACGCC
CTGTTCTACCGCCCCGACGTGGTGCCGCTGAACGAGACCAGCAACACCTCGGAGTACAGGCTGATCAACTGCAACACCTCCG
CGGTCACGCAGGCGTGCCCCAAGGTCACGTTCGAGCCCATCCCCATCCACTACTGCGCCCCCGCCGGCTACGCCATCCTGAA
GTGCAACAACGAGACCTTCAACGGGACCGGCCCGTGCAGCAACGTGTCCACCGTGCAGTGCACGCACGGCATCCGGCCCGTG
GTGTCCACGCAGCTGCTCCTGAACGGGTCGCTGGCGGAGAAGGAGATCGTCATCCGGTCCGAGAACCTCACGAACAACGCGA
AGATCATCATCGTGCACCTGCACACGCCCGTGGAGATCGTGTGCACCCGCCCGGGCAACAACACGCGCAAGTCCGTCCGGAT
CGGCCCTGGCCAGACCTTCTACGCCACCGGCGACATCATCGGCGACATCCGCCAGGCCCACTGCAACATCAGCGAGGAGAAG
TGGAACAAGACCCTGCAGCAGGTGGGCAAGGAGCTGCAGAAGCACTTCCCCAACAAGACGATTAAGTACGAGCGGTCGGCCG
GCGGCGACATGGAGATCACCACGCACTCCTTCAACTGCGGTGGCGAGTTCTTCTACTGCAACACGTCGAACCTGTTCAACGG
CACCTACAACGGCAAGTACATCAACATCTCCACGAACTCCAACAGCACGATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACCGGCC
TCCTGCTGACCCGCGACGGCGGCACCAAGAACAACTCGACGGAGACGGAGGAGACCTTCAGGCCAGCGGGAGGCGACATGCG
CGACAACTGGCGCTCCGAGCTGTACAAGTACAAGGTGGTGGAGATCCAGCCCCTGGGCATCGCACCCACCGGGGCCAAGgag
CGGGTCGTGGAGCGCGAGAAGgagTAGTAAGggacctgaattcggtgaccggatcc
>HV1300925_CH848.3.d0526.25.11D11gp120
GgtcgacaagaaGCCACCATGCGGGTGATGGGCATCCTCAAGAACTGCCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
CACGCGCTCGAACGTGTCCGTCACGTCCATCAACAACACGATCATGGGCGAGATGAAGAACTGCTCCTTCAACACGACGACG
GAGATCCGCGACAAGGAGAAGAAGGAGTACGCCCTGTTCTACCGCCCCGACATCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGAACACGCCCGTGGAGATCGTGTGCACCCG
CCCGTCCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCAGAAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAACCTGTTCAACGGCACCTACAACGGCACGTACACCAACATCTCCACGAACTCCAACAGCACG
ATCACGCTCCAGTGCCGCATCAAGCAGATCATCAACATGTGGCAGGGGGTGGGCCGCGCTATGTACGCACCGCCCATCGCCG
GCAACATCACCTGCCGGTCCAACATCACCGGCCTCCTGCTGACCCGCGACGGCGGCACCAACTCGAACAAGACGGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGggtcctgaattcggtgaccggatc
c
>HV1300926_CH848.3.d0526.25.21D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTGCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCGTGAACGTCACGAACATCACGAACACGATCAAGGG
CGAGATGAAGAACTGCTCCTTCAACACGACGACGGAGATCCGCGACAAGGAGAAGAAGGAGTACGCCCTGTTCTACCGCCCC
GACGTCGTGCCGCTGAACGAGACCAGCAACACCTCGGAGTACAGGCTGATCAACTGCAACACCTCCGCGGTCACGCAGGCGT
```

Figure 5 continued
```
GCCCCAAGGTCACGTTCGAGCCCATCCCCATCCACTACTGCGCCCCCGCCGGCTACGCCATCCTGAAGTGCAACAACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGGGATCGTCATCCGGTCCGAGAACCTCACGAACAACGCGAAGATCATCATCGTGC
AGCTGAACACGTCGGTGGAGATCGTGTGCACCCGCCCGGGGAACAACACGCGCAAGTCCGTCCGGATCGGCCCTGGCCAGAC
CTTCTACGCCACCGGCGACATCATCGGCGACATCCGCCAGGCCCACTGCAACATCAGCGAGGAGAAGTGGAACAAGACCCTG
CAGCAGGTGGGCAAGGAGCTGCAGAAGCACTTCCCCAACAAGACGATTAAGTACGAGCGGTCGGCCGGCGGCGACATGGAGA
TCACCACGCACTCCTTCAACTGCGGTGGCGAGTTCTTCTACTGCAACACGTCGAACCTGTTCAACGGCACCTACAACGGCAC
GTACAACGGCTCCACGAACTCCAACAGCACGATCACGCTCCAGTGCCGCATCAAGCAGATCATCAACATGTGGCAGGGGGTG
GGCCGCGCTATGTACGCACCGCCCATCGCCGGCAACATCACCTGCCGGTCCAACATCACCGGCCTCCTGCTGACCCGCGACG
GCGGCACCAACTCGAACAAGACGGAGGAGACCTTCAGGCCAGCGGGAGGCGACATGCGCGACAACTGGCGCTCCGAGCTGTA
CAAGTACAAGGTGGTGGAGATCCAGCCCCTGGGCATCGCACCCACCGGGGCCAAGgagCGGGTCGTGGAGCGCGAGAAGgag
TAGTAAGggtcccgaattcggtcaccggatcc
>HV1300927_CH848.3.d0526.25.32D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCCGCGCCTA
CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
CACGCGCTCCAACGCGAACGTCACGTCCATCAACAACACGATCATGGGCGAGATGAAGAACTGCTCCTTCAACACGACGACG
GAGATCCGCGACAAGGAGAAGAAGGAGTACGCCCTGTTCTACCGGCCCGACATCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGCACACGCCCGTGGAGATCGTGTGCACCCG
CCCGGGCAACAACACGCGCAAGTCCGTCCGGATCGGCCCTGGCCCAGACCTTCTACGCCACCGGCGACATCATCGGCGACATC
CGCCAGGCCCACTGCAACATCAGCGAGGAGAAGTGGAACAAGACCCTGCAGAAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAACCTGTTCAACGGCACCTACAACGGCACCTACAACGGGACCAACTCGAACAGCACGATCACG
CTCCAGTGCCGCATCAAGCAGATCATCAACATGTGGCAGGGGGTGGGCCGCGCTATGTACGCACCGCCCATCGCCGGCAACA
TCACCTGCCGGTCCAACATCACCGGCCTCCTGCTGACCCGCGACGGCGGCACCAACTCCAACAAGACGGAGGAGACCTTCAG
GCCAGCGGGAGGCGACATGCGCGACAACTGGCGCTCCGAGCTGTACAAGTACAAGGTGGTGGAGATCCAGCCCCTGGGCATC
GCACCCACCGGGGCCAAGgagCGGGTCGTGGAGCGCGAGAAGgagTAGTAAGaggacccgaattcggtcaccggatcc
>HV1300928_CH848.3.d0526.25.39D11gp120
GgtcgacaagaaGCCACCATGCGGGTGATGGGCATCCCCAAGAACTACCCGCAGTGGTGGATCTGGGGCATCCTGGGCTTCT
GGATGCTCATGATCTGCTCGggcgtgCCGGTGTGGAAGGAGGCCAAGACGACCCTGTTCTGCGCGTCGGACGCCAAGGCCTA
CGAGAAGGAGATGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
CACGCGCTCCAACGTGAACGTCACGTCCATCAACAACACGATCATGGGCGAGATGAAGAACTGCTCCTTCAACACGACGACG
GAGATCCGCGACAAGGAGAAGAAGGAGTACGCCCTGTTCTACAAGCCCGACATCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGAACACGCCCGTGGAGATCGTGTGCACCCG
CCCGGGCAACAACACGCGCAAGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCAGAAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAAGCTGTTCAACGGCACCTACAACGGGATCAACATCTCGACCAACTCGAACAGCACGATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCAACCGGAACAACAGCAACGAGGAGACCTTCAG
GCCAGCGGGAGGCGACATGCGCGACAACTGGCGCTCCGAGCTGTACAAGTACAAGGTGGTGGAGATCCAGCCCCTGGGCATC
GCACCCACCGGGGCCAAGgagCGGGTCGTGGAGCGCGAGAAGgagTAGTAAGaggtcccgaattcggtcaccggatcc
>HV1300929_CH848.3.d0611.9.02D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
```

Figure 5 continued

```
CAAGAAGGAGGTGCACAACGTGTGGGCGACCCACGCCTGCGTGCCCACGGACCCCAGCCCGCAGGAGCTCGTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
GATGAAGAACTGCTCCTTCAACACGACGACGGAGATCCGCGACAAGGAGAAGAAGGAGTACGCCCTGTTCTACCGGCCCGAC
ATCGTGCCGCTGGGCGAGACCAGCAACACCTCGGAGTACAGGCTGATCAACTGCAACACCTCCGCGGTCACGCAGGCGTGCC
CCAAGGTCACGTTCGAGCCCATCCCCATCCACTACTGCGCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGGGATCGTCATCCGGTCCGAGAACCTCACGAACAACGCGAAGATCATCATCGTGCACC
TGCACACGCCCGTGGAGATCGTGTGCACCCGCCCGGGCAACAACACGCGCAAGTCCGTCCGGATCGGCCCTGGCCAGACCTT
CTACGCCACCGGCGACATCATCGGCGACATCCGCCAGGCCCACTGCAACATCAGCGAGGAGAAGTGGAACGAGACCCTGCAG
AAGGTGGGCAAGGAGCTGCAGAAGCACTTCCCCAACAAGACGATTAAGTACGCCCAGTCGGCCGGCGGCGACATGGAGATCA
CCACGCACTCCTTCAACTGCGGTGGCGAGTTCTTCTACTGCAACACGTCGAAGCTGTTCAACGGGACGTACAACGGCGCCTA
CATCAACATCTCGACCAACTCGAACAGCACGATCACGCTCCAGTGCCGCATCAAGCAGATCATCAACATGTGGCAGGGGGTG
GGCCGCGCTATGTACGCACCGCCCATCGCCGGCAACATCACCTGCAAGTCCAACATCACCGGCCTCCTGCTGACCCGCGACG
GCGGCACGAACAACAAGACGGAGGAGATCTTCAGGCCAGCGGGAGGCGACATGCGCGACAACTGGCGCTCCGAGCTGTACAA
GTACAAGGTGGTGGAGATCCAGCCCCTGGGCATCGCACCCACCGGGGCCAAGgagCGGGTCGTGGAGCGCGAGAAGgagTAG
TAAGggacctgaattcggtcaccggatcc
>HV1300930_CH848.3.d0611.20.12D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCATGGGCGA
GATGAAGAACTGCTCCTTCAACACGACGACGGAGATCCGCGACAAGGAGAAGAAGGAGTACGCCCTGTTCTACAAGCCCGAC
GTCGTGCCGCTGGACGAGACCAACAACACCTCGGAGTACAGGCTGATCAACTGCAACACCTCCGCGGTCACGCAGGCGTGCC
CCAAGGTCACGTTCGAGCCCATCCCCATCCACTACTGCGCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTGATCCGGTCCGAGAACCTCACGAACAACGCGAAGATCATCATCGTGCACC
TGAACACGCCCGTGGAGATCGTGTGCACCCGCCCGGGCAACAACACGCGCAAGTCCGTCCGGATCGGCCCTGGCCAGACCTT
CTACGCCACCGGCGCGATCATCGGCGACATCCGCCAGGCCCACTGCAACATCAGCGAGTCCAAGTGGAACGAGACCCTGCAG
AAGGTGGGCAAGGAGCTGCAGAAGCACTTCCCCAACAAGACGATTAAGTACGAGCAGTCGGCCGGCGGCGACATGGAGATCA
CCACGCACTCCTTCAACTGCGGTGGCGAGTTCTTCTACTGCAACACGTCGAAGCTGTTCAACGGGACGTACAACGGCGCCTA
CATCAACATCTCGACCAACTCGAACAGCACGATCACGCTCCAGTGCCGCATCAAGCAGATCATCAACATGTGGCAGGGGGTG
GGCCGCGCTATGTACGCACCGCCCATCGCCGGCAACATCACCTGCAAGTCCAACATCACCGGCCTCCTGCTGACCCGCGACG
GCGGCACGAACAACAAGACGGAGGAGATCTTCAGGCCAGCGGGAGGCGACATGCGCGACAACTGGCGCTCCGAGCTGTACAA
GTACAAGGTGGTGGAGATCCAGCCCCTGGGCATCGCACCCACCGGGGCCAAGgagCGGGTCGTGGAGCGCGAGAAGgagTAG
TAAGggtcctgaattcggtcaccggatcc
>HV1300931_CH848.3.d0611.20.14D11gp120
GgtcgacaagaaGCCACCATGAAGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTCCTGGGGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
GATGAAGAACTGCTCCTTCAACACGACGACGGAGATCCGCGACAAGGAGAAGAAGGAGTACGCCCTGTTCTACCGGCCCGAC
ATCGTGCCGCTGAACGAGACCAGCAACACCTCGGAGTACAGGCTGATCAACTGCAACACCTCCGCGGTCACGCAGGCGTGCC
CCAAGGTCACGTTCGAGCCCATCCCCATCCACTACTGCGCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGCACACGCCCGTGGAGATCGTGTGCACCCGCCCGGGCAACAACACGCGCAAGTCCGTCCGGATCGGCCCTGGCCAGACCTT
CTACGCCACCGGCGACATCATCGGCGACATCCGCCAGGCCCACTGCAACATCAGCGAGAAGCAGTGGAACGAGACCCTGCAG
AAGGTGGGCAAGGAGCTGCAGAAGCACTTCCCCAACAAGACGATTAAGTACGAGAGGTCGGCCGGCGGCGACATGGAGATCA
CCACGCACTCCTTCAACTGCGGTGGCGAGTTCTTCTACTGCAACACGTCGAAGCTGTTCAACGGCACGTACAACGGGACCGA
CATCTCCACGAACTCGTCCGCGAACTCGAACAGCACGATCACGCTCCAGTGCCGCATCAAGCAGATCATCAACATGTGGCAG
GGGGTGGGCCGCGCTATGTACGCACCGCCCATCGCCGGCAACATCACCTGCAAGTCCAACATCACCGGCCTCCTGCTGACCC
GCGACGGCGGCACGAACAGCTCGGAGGAGATCTTCAGGCCAGCGGGAGGCGACATGCGCGACAACTGGCGCTCCGAGCTGTA
```

Figure 5 continued

CAAGTACAAGGTGGTGGAGATCCAGCCCCTGGGCATCGCACCCACCGGGGCCAAGgagCGGGTCGTGGAGCGCGAGAAGgag
TAGTAAGggtcccgaattcggtaaccggatcc
>HV1300932_CH848.3.d0611.20.28D11gp120
GgtcgacaagaaGCCACCATGCGGGTGATGGGCATCCTCAAGAACTGCCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCCGCGCCTA
CGAGAAGGAGGTGCACAACGTGTGGGCGACCCACGCCTGCGTGCCCACGGACCCCAGCCCGCAGGAGCTCGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
GATGAAGAACTGCTCCTTCAACACGACGACGGAGATCCGCGACAAGGAGAAGAAGGAGTACGCCCTGTTCTACCGGCCCGAC
ATCGTGCCGCTGAACGAGACCAGCAACACCTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACAACAAGACCTT
CAACGGGACCGGCCCGTGCAGCAAGGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGCACACGCCCGTGGAGATCGTGTGCACCCGCCCGGGCAACAACACGCGCAAGTCCGTCCGGATCGGCCCTGGCCAGACCTT
CTACGCCACCGGCGACATCATCGGCGACATCCGCCAGGCCCACTGCAACATCAGCGAGGAGAAGTGGAACGAGACCCTGCAG
AAGGTGGGCAAGGAGCTGCAGAAGCACTTCCCCAACAAGACGATTAAGTACGCCCAGTCGGCCGGCGGCGACATGGAGATCA
CCACGCACTCCTTCAACTGCGGTGGCGAGTTCTTCTACTGCAACACGTCGAAGCTGTTCAACGGGACGTACAACGGCGCCTA
CATCAACATCTCGACCAACTCGAACAGCACGATCACGCTCCAGTGCCGCATCAAGCAGATCATCAACATGTGGCAGGGGGTG
GGCCGCGCTATGTACGCACCGCCCATCGCCGGCAACATCACCTGCAAGTCCAACATCACCGGCCTCCTGCTGACCCGCGACG
GCGGCACGAACAACAAGACGGAGGAGATCTTCAGGCCAGCGGGAGGCGACATGCGCGACAACTGGCGCTCCGAGCTGTACAA
GTACAAGGTGGTGGAGATCCAGCCCCTGGGCATCGCACCCACCGGGGCCAAGgagCGGGTCGTGGAGCGCGAGAAGgagTAG
TAAGaggacccgaattcggtaaccggatcc
>>HV1300933_CH848.3.d0700.15.06D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCGTCCTGAAGAAC
GTGACCGAGAACTTCAACATGTGGAAGAACAACCGGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGGACAACCGCACCGTCGGGGA
GATGAAGAACTGCTCCTTCAACACGACGACGGAGATCCGCGACAAGGAGAAGAAGGAGTACGCCCTGTTCTACAAGCCCGAC
GTCGTGCCGCTGGACGAGACCAACAACACCTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACAACGAGACCTT
CAACCGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGAACACGCCCGTGGAGATCGTGTGCACCCGCCCGAACAACAACACGCGCAAGTCCGTCCGGATCGGCCCTGGCCAGACCTT
CTACGCCACCGGCGCATCATCGGCGACATCCGCCAGGCCCACTGCAACATCAGCGAGGGGCAGTGGAACGAGACCCTGCAG
AAGGTGGGCAAGGAGCTGCAGAAGCACTTCCCCAACAAGACGATTAAGTACGAGCAGTCGGCCGGCGGCGACATGGAGATCA
CCACGCACTCCTTCAACTGCGGTGGCGAGTTCTTCTACTGCAACACGTCGAAGCTGTTCAACGGCACGTACAACGGCACCTA
CATCTCCACGAACTCGTCCACCAACTCGACGAGCACGATCACGCTCCAGTGCCGCATCAAGCAGATCATCAACATGTGGCAG
GGGGTGGGCCGCGCTATGTACGCACCGCCCATCGCCGGCAACATCACCTGCAAGTCCAACATCACCGGCCTCCTGCTGACCC
GCGACGGCGGCACGAACAGCTCGGAGGAGATCTTCAGGCCAGCGGGAGGCGACATGCGCGACAACTGGCGCTCCGAGCTGTA
CAAGTACAAGGTGGTGGAGATCCAGCCCCTGGGCATCGCACCCACCGGGGCCAAGgagCGGGTCGTGGAGCGCGAGAAGgag
TAGTAAGaggtcccgaattcggtaaccggatcc
>HV1300934_CH848.3.d0700.15.15D11gp120
GgtcgacaagaaGCCACCATGCGGGTGACGGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
CTCGCGGTCCAACGACAACGTGACCTCGATCAACAACACGATCATGGGGGAGATGAAGAACTGCTCCTTCAACACGACGACG
GAGATCCGCGACAAGGAGAAGAAGGAGTACGCCCTGTTCTACCGCCCCGACATCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACGACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGCACACGCCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC

Figure 5 continued

CGCCAGGCCCACTGCAACATCAGCGAGGAGAAGTGGAACAAGACCCTGCAGAAGGTGGGCAAGGAGCTGCAGAAGCACTTCC
CCAACAAGACGATTAAGTACGAGCGCCCCGCCGGCGGCGACCTGGAGATCACCACGCACTCCTTCAACTGCGGTGGCGAGTT
CTTCTACTGCAACACGTCGAAGCTGTTCAACGGCACGTACAACGGCACCGACATCTCCACGAACTCGTCCACCAACTCGACG
AGCACGATCACGCTCCAGTGCCGCATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCACGAACAGCTCGGAGGAGAT
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagTAGTAAGggacctgaattcggtaaccggatc
c
>HV1300935_CH848.3.d0700.15.29D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTGCTGGGGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
CTCGCGGTCCAACGACAACGTGACCTCGATCAACAACACGATCATGGGGGAGATGAAGAACTGCTCCTTCAACACGACGACG
GAGATCCGCGACAAGGAGAAGAAGGAGTACGCCCTGTTCTACCGCCCCGACATCGTGCCGCTGAACGAGAACGAGACCAGCA
ACACCTCGGAGTACAGGCTGATCAACTGCAACACCTCCGCGGTCACGCAGGCGTGCCCCAAGGTCACGTTCGAGCCCATCCC
CATCCACTACTGCGCCCCCGCCGGCTACGCCATCCTGAAGTGCAACAACGAGACCTTCAACGGGACCGGCCCGTGCAGCAAC
GTGTCCACCGTGCAGTGCACGCACGGCATCCGGCCCGTGGTGTCCACGCAGCTGCTCCTGAACGGGTCGCTGGCGGAGAAGG
AGATCGTCATCCGGTCCGAGAACCTCACGAACAACGCGAAGATCATCATCGTGCACCTGCACACGCCCGTGGAGATCGTGTG
CACCCGCCCGGGCAACAACACGCGCAAGTCCGTCCGGATCGGCCCTGGCCAGACCTTCTACGCCACCGGCGACATCATCGGC
GACATCCGCCAGGCCCACTGCAACATCAGCGAGGAGAAGTGGAACGAGACCCTGCAGAAGGTGGGCAAGGAGCTGCAGAAGC
ACTTCCCCAACAAGACGATTAAGTACGCGCAGTCGGCCGGCGGCGACATGGAGATCACCACGCACTCCTTCAACTGCGGTGG
CGAGTTCTTCTACTGCAACACGTCGAACCTGTTCAACGGCACGTACAACGGCACCTACATCTCCACGAACTCGTCCGCCAAC
TCGACGAGCACGATCACGCTCCAGTGCCGCATCAAGCAGATCATCAACATGTGGCAGGGGGTGGGCCGCGCTATGTACGCAC
CGCCCATCGCCGGCAACATCACCTGCAAGTCCAACATCACCGGCCTCCTGCTGACCCGCGACGGCGGCACGAACAACACCAG
CAACGAGGAGACGTTCAGGCCAGCGGGAGGCGACATGCGCGACAACTGGCGCTCCGAGCTGTACAAGTACAAGGTGGTGGAG
ATCCAGCCCCTGGGCATCGCACCCACCGGGGCCAAGgagCGGGTCGTGGAGCGCGAGAAGgagTAGTAAGggtcctgaattc
ggtaaccggatcc
>HV1300936_CH848.3.d0700.27.06D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAAGggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACCGCACCGTCTACGA
GATGAAGAACTGCTCCTTCAACACGACGACGGAGATCCGCGACAAGGAGAAGAAGGAGTACGCCCTGTTCTACCGCTCGGAC
GTCGTGCCGCTGGACGAGACCAACAACACCTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGCACACGCCCGTGGAGATCGTGTGCACCCGCCCGGGCAACAACACGCGCAAGTCCGTCCGGATCGGCCCTGGCCAGACCTT
CTACGCCACCGGCGACATCATCGGCGAGATCCGCCAGGCCCACTGCAACATCAGCGAGTCGAAGTGGAACGAGACCCTGCAG
AAGGTGGGCAAGGAGCTGCAGAAGCACTTCCCCAACAAGACGATTAAGTACGAGCGCTCGGCCGGCGGCGACATGGAGATCA
CCACGCACTCCTTCAACTGCGGTGGCGAGTTCTTCTACTGCAACACGTCGAAGCTGTTCAACGGCACGTACAACGGCACCGA
CATCTCCACGAACTCGTCCGCCAACTCGAACAGCACGATCACGCTCCAGTGCCGCATCAAGCAGATCATCAACATCTGGCAG
GGGGTGGGCCGCGCTATGTACGCACCGCCCATCGCCGGCAACATCACCTGCAAGTCCAACATCACCGGCCTCCTGCTGACCC
GCGACGGCGGCAACAACAACAACCGGAACGAGGAGACGTTCAGGCCAGCGGGAGGCGACATGCGCGACAACTGGCGCTCCGA
GCTGTACAAGTACAAGGTGGTGGAGATCCAGCCCCTGGGCATCGCACCCACCGGGGCCAAGgagCGGGTCGTGGAGCGCGAG
AAGgagTAGTAAGggtcccgaattcggttaccggatcc
>HV1300937_CH848.3.d0794.5.27D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCCGGGCCTA
CGAGAAGGAGGTGCACAACGTGTGGGCGACCCACGCCTGCGTGCCCACGGACCCCAGCCCGCAGGAGCTCGTCCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGGACAACCGCACCGTCGGCGA

Figure 5 continued

```
GATGAAGAACTGCTCCTTCAACACGACGACGGAGATCCGCGACAAGGAGAAGAAGGAGTACGCCCTGTTCTACCGCCCGGAC
ATCGTGCCGCTGTCCGAGACCAACAACACCTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGAACACGCCCGTGGAGATCGTGTGCACCCGCCCGAACAACAACACGCGCAAGTCCGTCCGGATCGGCCCTGGCCAGACCTT
CTACGCCACCGGCGACATCATCGGCGAGATCAAGCAGGCCCACTGCAACATCAGCGAGGAGAAGTGGAACGAGACCCTGCAG
AAGGTGGGCAAGGAGCTGCAGAAGCACTTCCCCAACAAGATCATTAAGTACGCCCAGTCGGCCGGCGGCGACATGGAGATCA
CCACGCACTCCTTCAACTGCGGTGGCGAGTTCTTCTACTGCAACACGGCGAACCTGTTCAACGGCACGTACAACGGCACCGA
CATCTCCACGAACTCGTCCACCAAGTCGAACAGCACGATCACGCTCCAGTGCCGCATCAAGCAGATCATCAACATGTGGCAG
GGGGTGGGCCGCGCTATGTACGCACCGCCCATCGCCGGCAACATCACCTGCCGGTCCACCATCACCGGCCTCCTGCTGACCC
GCGACGGCGGCACGAACTCGAGCAAGACGGAGGAGGAGACGTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGaggacccgaattcggttaccggatcc
>HV1300938_CH848.3.d0794.5.41D11gp120
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACCGCACCGTCGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACAACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGAACACGCCCGTGGAGATCGTGTGCACCCGCCCGAACAACAACACGCGCAAGTCCGTCCGGATCGGCCCTGGCCAGAC
CTTCTACGCCACCGGCGACATCATCGGCGACATCCGGCAGGCCCACTGCAACATCAGCGAGAAGGAGTGGAACGACACCCTG
CAGAAGGTGGGCAAGGAGCTGCAGAAGCACTTCCCCAACAAGACCATTGAGTACAAGCAGTCGGCCGGCGGCGACATGGAGA
TCACCACGCACTCCTTCAACTGCGGTGGCGAGTTCTTCTACTGCAACACGTCCAACCTGTTCAACGGCACGTACAACGGCAC
CTACATGAACATCTCCACCGACTCGAACAGCACGATCACGCTCCAGTGCCGCATCAAGCAGATCATCAACATGTGGCAGGGG
GTGGGCCGCGCTATGTACGCACCGCCCATCGCCGGCAACATCACCTGCCGGTCCAACATCACCGGCCTCCTGCTGACCCGCG
ACGGCGGCACGAACTCGAGCAAGACGGAGGAGGAGACGTTCAGGCCAGCGGGAGGCGACATGCGCGACAACTGGCGCTCCGA
GCTGTACAAGTACAAGGTGGTGGAGATCCAGCCCCTGGGCATCGCACCCACCGGGGCCAAGgagCGGGTCGTGGAGCGCGAG
AAGgagTAGTAAGaggtcccgaattcggttaccggatcc
>HV1300939_CH848.3.d0836.10.36D11gp120
GgtcgacaagaaGCCACCATGCGGGTGATGGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACTCCACCGTCGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGGGATCGTCATCCGGTCCGAGAACCTCACGAACAACGCGAAGATCATCATCGTGC
ACCTGCACACGCCCGTGGAGATCGTGTGCACCCGCCCGAACAACAACACGCGCAAGTCCGTCCGGATCGGCCCTGGCCAGAC
CTTCTACGCCACCGGCGACATCATCGGCGACATCCGGCAGGCCCACTGCAACATCAGCGAGTCCAAGTGGAACGAGACCCTG
CAGAAGGTGGGCAAGGAGCTGCAGAAGCACTTCCCCAACAAGACCATTAAGTACGAGCAGTCGGCCGGCGGCGACATGGAGA
TCACCACGCACTCCTTCAACTGCGGTGGCGAGTTCTTCTACTGCACCACGTCCAAGCTGTTCAACGGGACGTACAACGGCAC
GGACATCTCCACGAACTCCTCGGCGAACTCGAACCCGACGATCACGCTCCAGTGCCGCATCAAGCAGATCATCAACATGTGG
CAGGGGGTGGGCCGCGCTATGTACGCACCGCCCATCGCCGGCAACATCACCTGCAAGTCCAACATCACCGGCCTCCTGCTGA
CCCGCGACGGCGGCACGAACTCGAGCAAGACGGGAAGGAGGAGATCTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGggacctgaattcggttaccggatcc
>HV1300940_CH848.3.d0864.7.26D11gp120
```

Figure 5 continued

```
GgtcgacaagaaGCCACCATGCGCGTGACCGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCCGGGCCTA
CGAGAAGGAGGTGCACAACGTGTGGGCGACCCACGCCTGCGTGCCCACGGACCCCAGCCCGCAGGAGCTCGTGCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACTCCACGGTGGACGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACGAGAACGAGACGTCGAACACCTCGGAGTACAGGCTGATCAACTGCAACACCTCCGCGGTCACGCAGG
CGTGCCCCAAGGTCACGTTCGAGCCCATCCCCATCCACTACTGCGCCCCCGCCGGCTACGCCATCCTGAAGTGCAACGACGA
GACCTTCAACGGGACCGGCCCGTGCAGCAACGTGTCCACCGTGCAGTGCACGCACGGCATCCGGCCCGTGGTGTCCACGCAG
CTGCTCCTGAACGGGTCGCTGGCGGAGAAGGAGATCGTCATCCGGTCCGAGAACCTCACGAACAACGCGAAGATCATCATCG
TGCACCTGAACACGCCCGTGGAGATCGTGTGCACCCGCCCGAACAACAACACGCGCAAGTCCGTCCGGATCGGCCCTGGCCA
GACCTTCTACGCCACCGGCGACATCATCGGCGACATCCGGCAGGCCCACTGCAACATCAGCGAGAAGGAGTGGAACGAGACC
CTGCAGAAGGTGGGCAAGGAGCTGCAGAAGCACTTCCCCAACAAGACCATTAAGTACGCGCAGTCGGCCGGCGGCGACATGG
AGATCACCACGCACTCCTTCAACTGCGGTGGCGAGTTCTTCTACTGCAACACGGCCAACCTGTTCAACGGGACGTACAACGG
CACGGACATCTCCACGAACTCCTCGACGAAGTCGAACTCGACGATCACGCTCCAGTGCCGCATCAAGCAGATCATCAACATG
TGGCAGGGGGTGGGCCGCGCTATGTACGCACCGCCCATCGCCGGCAACATCACCTGCCGGTCCACCATCACCGGCTCCTGC
TGACCCGCGACGGCGACAACTCGAGCAAGACGGAGGAGGAGACCTTCAGGCCAGCGGGAGGCGACATGCGCGACAACTG
GCGCTCCGAGCTGTACAAGTACAAGGTGGTGGAGATCCAGCCCCTGGGCATCGCACCCACCGGGGCCAAGgagCGGGTCGTG
GAGCGCGAGAAGgagTAGTAAGgtcctgaattcggttaccggatcc
>HV1300941_CH848.3.d0864.7.39D11gp120
GgtcgacaagaaGCCACCATGCGCGTGATGGGCATCCCCAAGAACTGCCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACTCCACGGTGGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGAACACGCCCGTGGAGATCGTGTGCACCCGCCCGAACAACAACACGCGCAAGTCCGTCCGGATCGGCCCTGGCCAGAC
CTTCTACGCCACCGGCGACATCATCGGCGACATCCGGCAGGCCCACTGCAACATCAGCGAGAAGGAGTGGAACGACACCCTG
CAGAAGGTGGGCAAGGAGCTGCAGAAGCACTTCCCCAACAAGACCATTGAGTACAAGCAGTCGGCCGGCGGCGACATGGAGA
TCACCACGCACTCCTTCAACTGCGGTGGCGAGTTCTTCTACTGCAACACGGCCAAGCTGTTCAACGGGACGTACAACGGCAC
GGACATCTCCACGAACTCCTCGGCGGACTCGAACTCGACGATCACGCTCCAGTGCCGCATCAAGCAGATCATCAACATGTGG
CAGGGGGTGGGCCGCGCTATGTACGCACCGCCCATCGCCGGCAACATCACCTGCAAGTCCCACATCACCGGCCTCCTGCTGA
CCCGCGACGGCGGCACCAACTCGAGCGAGGAGGGAGATCTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGaattcggtgaccgggacccggatcc
>HV1300942_CH848.3.d0893.10.06D11gp120
GgtcgacaagaaGCCACCATGCGCGTGACGGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACTCCACGGTGGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGCACACGCCCGTGGAGATCGTGTGCACCCGCCCGAACAACAACACGCGCAAGTCCGTCCGGATCGGCCCTGGCCAGAC
CTTCTACGCCACCGGCGACATCATCGGCGACACGCGGCAGGCCCACTGCAACATCAGCGAGAAGAAGTGGAACGAGACCCTG
CAGAAGGTGGGCATCGAGCTGCAGAAGCACTTCCCCAACAAGACCATTAAGTACAACCAGTCGGCCGGCGGCGACATGGAGA
TCACCACGCACTCCTTCAACTGCGGTGGCGAGTTCTTCTACTGCAACACGTCGAACCTGTTCAACGGGACGTACAACGGCAC
CTACATCTCCACGAACTCCTCGGCGAACTCGACCTCGACGATCACGCTCCAGTGCCGCATCAAGCAGATCATCAACATGTGG
```

Figure 5 continued

CAGGGGGTGGGCCGCGCTATGTACGCACCGCCCATCGCCGGCAACATCACCTGCCGGTCCAACATCACCGGCCTCCTGCTGA
CCCGCGACGGCGGCACCAACTCGAACGAGACGGAGACCTTCAGGCCAGCGGGAGGCGACATGCGCGACAACTGGCGCTCCGA
GCTGTACAAGTACAAGGTGGTGGAGATCCAGCCCCTGGGCATCGCACCCACCGGGGCCAAGgagCGGGTCGTGGAGCGCGAG
AAGgagTAGTAAGaattcggtcaccgggacccggatcc
>HV1300943_CH848.3.d1120.10.13D11gp120
GgtcgacaagaaGCCACCATGCGCGTGACGGGCATCCTCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGCACGCCACGGTGGAGAACTCCACGACCGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGCACACGCCCGTGGAGATCGTGTGCACCCGCCCGAACAACAACACGCGCAAGTCCGTCCGGATCGGCCCTGGCCAGAC
CTTCTACGCCACCGGCGGCATCATCGGCGAGATCCGGCAGGCCCACTGCAACATCAGCAAGGAGACCTGGAACGACACCCTG
CAGAAGGTGGGCAAGGAGCTGCAGAAGCACTTCCCCAACAAGACCATCCGCTACAACCAGTCGGCCGGCGGCGACATGGAGA
TCACCACGCACTCCTTCAACTGCGGTGGCGAGTTCTTCTACTGCAACACGGCCAAGCTGTTCAACTCGACGTACAACGGCAC
CTACATCTCCACGAACTCCACGAACTCGACCTCGTACATCACGCTCCAGTGCCGCATCAAGCAGATCATCAACATGTGGCAG
GGGGTGGGCCGCGCTATGTACGCACCGCCCATCGCCGGCAACATCACCTGCCGGTCCAACATCACCGGCCTCCTGCTGACCC
GCGACGGCGGCACCAACTCGTCGGAGGAGGAGATCTTCAGGCCAGCGGGAGGCGACATGCGCGACAACTGGCGCTCCGAGCT
GTACAAGTACAAGGTGGTGGAGGTGCAGCCCCTGGGCATCGCACCCACCGGGGCCAAGgagCGGGTCGTGGAGCGCGAGAAG
gagTAGTAAGaattcggtaaccgggacccggatcc
>HV1300944_CH848.3.d1120.10.21D11gp120
GgtcgacaagaaGCCACCATGCGCGTGACGGGCATCCTCAAGAACTACCCGCAGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATGTGCTCGAACGCCATCGTGAAGAACTCCACGACCGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACAAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGCACACGCCCGTGCAGATCGTGTGCACCCGCCCGAACAACAACACGCGCAAGTCCGTCCGGATCGGCCCTGGCCAGAC
CTTCTACGCCACCGGCGACATCATCGGCGACCCGCGGCAGGCCCACTGCAACATCAGCGAGAAGAAGTGGAACGAGACCCTG
CAGAAGGTGGGCATCGAGCTGCAGAAGCACTTCCCCAACAAGACCATCAAGTACAACCAGTCGGCCGGCGGCGACATGGAGA
TCACCACGCACTCCTTCAACTGCGGTGGCGAGTTCTTCTACTGCAACACGGCCAAGCTGTTCAACTCGACGTACAACGGCAC
CTACATCTCCACGAACTCCACGGACTCGACCTCGAACATCACGCTCCAGTGCCGCATCAAGCAGATCATCAACATGTGGCAG
GGGGTGGGCCGCGCTATGTACGCACCGCCCATCGCCGGCAACATCACCTGCCGGTCCAACATCACCGGCCTCCTGCTGACCC
GCGACGGCGGCATCAACAACGACTCGAACGAGACGGAGACCTTCAGGCCAGCGGGAGGCGACATGCGCGACAACTGGCGCTC
CGAGCTGTACAAGTACAAGGTGGTGGAGGTGCAGCCCCTGGGCATCGCACCCACCGGGGCCAAGgagCGGGTCGTGGAGCGC
GAGAAGgagTAGTAAGaattcggttaccgggacccggatcc
>HV1300945_CH848.3.d1120.10.24D11gp120
GgtcgacaagaaGCCACCATGCGCGTGATGGGCATCCTCAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTCCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGACGGCCACGGTGAACAAGTCCACGGTGGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC

Figure 5 continued

ACCTGCACACGCCCGTGGAGATCGTGTGCACCCGCCCGAACAACAACACGCGCAAGTCCGTCCGGATCGGCCCTGGCCAGAC
CTTCTACGCCACCGGCGGGATCGTCGGCGACATCCGGCAGGCCCACTGCAACATCAGCAAGGGCCTCTGGAACGACACCCTG
CAGAAGGTGGGCATCGAGCTGCAGAAGCACTTCCCCAACAAGACCATCAAGTACAACCAGTCGGCCGGCGGCGACATGGAGA
TCACCACGCACTCCTTCAACTGCGGTGGCGAGTTCTTCTACTGCAACACGAGCAACCTGTTCAACGGCACGTACAACGGCAC
CTACATCTCCACGAACTCGTCCGCGAACTCGACCTCGTACATCACGCTCCAGTGCCGCATCAAGCAGATCATCAACATGTGG
CAGGGGGTGGGCCGCGCTATGTACGCACCGCCCATCGCCGGCAACATCACCTGCCGGTCCAACATCACCGGCCTCCTGCTGA
CCCGCGACGGCGGCACGACCAACAACTCGAACGAGACGGAGACCTTCAGGCCAGCGGGAGGCGACATGCGCGACAACTGGCG
CTCCGAGCTGTACAAGTACAAGGTGGTGGAGATCCAGCCCCTGGGCATCGCACCCACCGGGGCCAAGgagCGGGTCGTGGAG
CGCGAGAAGgagTAGTAAGaattcggtgaccgggtcccggatcc
>HV1300946_CH848.3.d1120.10.32D11gp120
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCGTCCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTGGAGAACGGCACGGTGGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGTCGAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGGCATCGTCATCCGGTCCGAGAACCTCACGAACAACGCGAAGATCATCATCGTGC
AGCTGAACACGTCCGTGGAGATCGTGTGCACCCGCCCGAACAACAACACGCGCAAGTCCGTCCGGATCGGCCCTGGCCAGAC
CTTCTACGCCACCGGCGACATCATCGGCGACCCGCGGCAGGCCCACTGCAACATCAGCAAGGAGAAGTGGAACGACACCCTG
CAGAAGGTGGGCAAGGAGCTGCAGAAGCACTTCCCCAACAAGACCATCCGCTACAACCAGTCGGCCGGCGGCGACATGGAGA
TCACCACGCACTCCTTCAACTGCGGTGGCGAGTTCTTCTACTGCAACACGGCGAAGCTGTTCAACAGCACGTACAACGGCAC
CTACATCTCCACGAACTCGACGAACTCGACCTCGAACATCACGCTCCAGTGCCGCATCAAGCAGATCATCAACATGTGGCAG
GGGGTGGGCCGCGCTATGTACGCACCGCCCATCGCCGGCAACATCACCTGCCGGTCCAACATCACCGGCCTCCTGCTGACCC
GCGACGGCGGCACGACCAACAACTCGAACGAGACGGAGACCTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGaattcggtgaccaggacccggatcc
>HV1300947_CH848.3.d1120.10.41D11gp120
GgtcgacaagaaGCCACCATGCGCGTGATGGGCATCCAGAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCCGCGCCTA
CGAGAAGGAGGTGCACAACGTGTGGGCGACCCACGCCTGCGTGCCCACGGACCCCAGCCCGCAGGAGCTCGTCCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAAGAACTCGACCACGGGAGGA
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACGAGACGGGCAACACCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
AGCTGAACACGTCCGTGGAGATCGTGTGCACCCGCCCGAACAACAACACGCGCAAGTCCGTCCGGATCGGCCCTGGCCAGAC
CTTCTACGCCACCGGCGACATCATCGGCGACATCAAGCAGGCCCACTGCAACATCAGCGAGGAGAAGTGGAACGACACCCTG
CAGAAGGTGGGCATCGAGCTGCAGAAGCACTTCCCCAACAAGACCATCAAGTACAACCAGTCGGCCGGCGGCGACATGGAGA
TCACCACGCACTCCTTCAACTGCGGTGGCGAGTTCTTCTACTGCAACACGCGAAGCTGTTCAACAGCACGTACAACGGCAC
CTACATCTCCACGAACTCGACGAACTCGACCTCGTACATCACGCTCCAGTGCCGCATCAAGCAGATCATCAACATGTGGCAG
GGGGTGGGCCGCGCTATGTACGCACCGCCCATCGCCGGCAACATCACCTGCCGGTCCAACATCACCGGCCTCCTGCTGACCC
GCGACGGCGGCATCAACAACGACTCGAACGAGACGGAGACCTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGaattcggtgaccaggtcccggatcc
>HV1300948_CH848.3.d1305.10.13D11gp120
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCCGGGCCTA
CGAGAAGGAGGTGCACAACGTGTGGGCGACCCACGCCTGCGTGCCCACGGACCCCAGCCCGCAGGAGCTCGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGATCGCCACGGCGAACGGCTCGACGGTGGAGGA

Figure 5 continued

```
GATGAAGAACTGCTCCTTCAACACGACGACGGAGATCCGCGACAAGGAGAAGAAGGAGTACGCCCTGTTCTACCGCCCGGAC
ATCGTGCCGCTGAACAACAAGACGTCGAACATCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACAACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGCACACGCCGGTGGAGATCGTGTGCACCCGCCCGAACAACAACACGCGCAAGTCCGTCCGGATCGGCCCTGGCCAGAC
CTTCTACGCCACCGGCGACATCATCGGCAACCCGCGGCAGGCCCACTGCAACATCAGCAAGGAGCGGTGGAACGACACCCTG
CAGAAGGTGGGCAAGGAGCTGCAGAAGCACTTCCCCAACAAGACCATCCGCTACAACCAGTCGGCCGGCGGCGACATGGAGA
TCACCACGCACTCCTTCAACTGCGGTGGCGAGTTCTTCTACTGCAACACGTCGAACCTGTTCAACAGCACGTACAACGACAC
CTACATCTCCACGAACTCGTCCGCGAACAACTCCTCGACGATCACGCTCCAGTGCCGCATCAAGCAGATCATCAACATGTGG
CAGGGGGTGGGCCGCGCTATGTACGCACCGCCCATCGCCGGCAACATCACCTGCAAGTCCAACATCACCGGCCTCCTGCTGA
CCCGCGACGGCGGCACGGACTCGAACGAGACGGAGACCTTCAGGCCAGCGGGAGGCGACATGCGCGACAACTGGCGCTCCGA
GCTGTACAAGTACAAGGTGGTGGAGATCCAGCCCCTGGGCATCGCACCCACCGGGGCCAAGgagCGGGTCGTGGAGCGCGAG
AAGgagTAGTAAGaattcggtgaccgggacctggatcc
>HV1300949_CH848.3.d1305.10.21D11gp120
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCAGCCCGCAGGAGCTCGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGGAGAACTCGACGACGGAGGA
GATGAAGAACTGCTCCTTCAACACGACGACGGAGATCCGCGACAAGGAGAAGAAGGAGCACGCCCTGTTCTACCGCCCGGAC
ATCGTGCCGCTGAACAACGAGACGGGCAACACGTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAAGGTGTCCACCGTGCAGTGCACGCACGGCATCCGGCCCGTGGTGTCCACGCAGCTG
CTCCTGAACGGGTCGCTGGCGGAGAAGGGGATCGTCATCCGGTCCGAGAACCTCACGAACAACGCGAAGATCATCATCGTGC
AGCTGAACACGCCGGTGGAGATCGTGTGCACCCGCCCGAACAACAACACGCGCAAGTCCGTCCGGATCGGCCCTGGCCAGAC
CTTCTACGCCACCGGCGACATCATCGGCAACATCCGGCAGGCCCACTGCAACATCAGCGAGTCGAAGTGGAACGACACCCTG
CAGAAGGTGGGCATCGAGCTGCAGAAGCACTTCCCCAACAAGACCATCAAGTACAACCAGTCGGCCGGCGGCGACATGGAGA
TCACCACGCACTCCTTCAACTGCGGTGGCGAGTTCTTCTACTGCAACACGGCGAAGCTGTTCAACAGCACGTACAACGGCAC
CTACATCTCCACGAACTCGACGAACTCGACGTCCAAGAACATCACGCTCCAGTGCCGCATCAAGCAGATCATCAACATGTGG
CAGGGGGTGGGCCGCGCTATGTACGCACCGCCCATCGCCGGCAACATCACCTGCCGCTCCAACATCACCGGCCTCCTGCTGA
CCCGCGACGGCGGCACGACGAACAACTCGAACGAGACGGAGACCTTCAGGCCAGCGGGAGGCGACATGCGCGACAACTGGCG
CTCCGAGCTGTACAAGTACAAGGTGGTGGAGGTCCAGCCCCCTGGGCATCGCACCCACCGGGGCCAAGgagCGGGTCGTGGAG
CGCGAGAAGgagTAGTAAGaattcggtgaccgggtcctggatcc
>HV1300950_CH848.3.d1305.10.30D11gp120
GgtcgacaagaaGCCACCATGCGCGTGACGGGCATCCTCAAGAACTACCCGCAGTGGTGGATCTGGGGCATCCTGGGCTTCT
GGATGCTCATGACGTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGAACAACTCGACGGTGGACGA
GATGAAGAACTGCTCCTTCAACACGACGACGGAGATCCGCGACAAGAAGAAGAAGGAGTACGCCCTGTTCTACCGCTCCGAC
GTCGTGCCGCTGGACGAGACGAACAACACGTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACGACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGCACACGCCGGTGGAGATCGTGTGCACCCGCCCGGGGCACAACACGCGCAAGTCCGTCCGGATCGGCCCTGGCCAGACCTT
CTACGCCACCGGCGACATCATCGGCGACATCCGGCAGGCCCACTGCAACATCAACGAGTCGGAGTGGAACGAGACCCTGCAG
AAGGTGGGCAAGGAGCTGCAGAAGCACTTCCCCAACAAGACCATCAAGTACGAGCAGTCGGCCGGCGGCGACATGGAGATCA
CCACGCACTCCTTCAACTGCGGTGGCGAGTTCTTCTACTGCAACACGGCGGAGCTGTTCAACGGCACGTACAACGGCACCGA
CATCTCCACGAACTCGTCGGCGAACTCCACGTCCACGATCACGCTCCAGTGCCGCATCAAGCAGATCATCAACATGTGGCAG
GGGGTGGGCCGCGCTATGTACGCACCGCCCATCGCCGGCAACATCACCTGCCGCTCCAACATCACCGGCCTCCTGCTGACCC
GCGACGGCGGCATCAACAACGTCTCGAACGAGACGGAGACCTTCAGGCCAGCGGGAGGCGACATGCGCGACAACTGGCGCTC
CGAGCTGTACAAGTACAAGGTGGTGGAGGTCCAGCCCCTGGGCATCGCACCCACCGGGGCCAAGgagCGGGTCGTGGAGCGC
GAGAAGgagTAGTAAGaattcggtcaccgggtcccggatcc
>HV1300951_CH848.3.d1305.10.35D11gp120
```

Figure 5 continued

```
GgtcgacaagaaGCCACCATGCGCGTGACGGGCATCCGGAAGAACTGCCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGACCGCCACGGTGAACAACTCGAAGTTCGAGGA
GATGAAGAACTGCTCCTTCAACACCACGACGGAGATCCGCGACAAGGAGAAGAAGGAGTACGCCCTGTTCTACCGCCCCGAC
ATCGTGCCGCTGGACAACGAGACGTCCAACATCTCGGAGTACAGGCTGATCAACTGCAACACCTCCGCGGTCACGCAGGCGT
GCCCCAAGGTCACGTTCGAGCCCATCCCCATCCACTACTGCGCCCCCGCCGGCTACGCCATCCTGAAGTGCAACGACGAGAC
CTTCAACGGGACCGGCCCGTGCAGCAACGTGTCCACCGTGCAGTGCACGCACGGCATCCGGCCCGTGGTGTCCACGCAGCTG
CTCCTGAACGGGTCGCTGGCGGAGAAGGAGATCGTCATCCGGTCCGAGAACCTCACGAACAACGCGAAGATCATCATCGTGC
ACCTGCACACGCCGGTGGAGATCGTGTGCACCCGCCCGAACAACAACACGCGCAAGTCCGTCCGGATCGGCCCTGGCCAGAC
CTTCTACGCCACCGGCGACATCATCGGCAACCCGCGGCAGGCCCACTGCAACATCTCGAAGGAGCGGTGGAACGACACCCTG
CAGAAGGTGGGCAAGGAGCTGCAGAAGCACTTCCCCAACAAGACCATCAAGTACAACCAGTCGGCCGGCGGCGACATGGAGA
TCACCACGCACTCCTTCAACTGCGGTGGCGAGTTCTTCTACTGCAACACGTCCAACCTGTTCAACTCGACGTACAACGACAC
CTACATCTCCACGAACTCGACCAACTCCACGTCCTACATCGGTCCAGTGCCGCATCAAGCAGATCATCAACATGTGGCAG
GGGGTGGGCCGCGCTATGTACGCACCGCCCATCGCCGGCAACATCACCTGCAAGTCCAACATCACCGGCCTCCTGCTGACCC
GCGACGGCGGCATCAACAAGGACTCGAACGAGACGGAGACCTTCAGGCCAGCGGGAGGCGACATGCGCGACAACTGGCGCTC
CGAGCTGTACAAGTACAAGGTGGTGGAGGTCCAGCCCCTGGGCATCGCACCCACCGGGGCCAAGgagCGGGTCGTGGAGCGC
GAGAAGgagTAGTAAGaattcggtcaccaggacccggatcc
>HV1300952_CH848.3.d1432.5.18D11gp120
GgtcgacaagaaGCCACCATGCGCGTGACGGGCATCCTGAAGAACTGCCCGCTGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTGAAGAACTCCACCACCGAGGA
GATGAGCAACGCCACCGTCAAGAACAGCACCACGGAGGAGATGTCCAACGCCACGGTGAAGAACTCGACGACAGAGGAGATG
AAGAACTGCTCCTTCAACACCACGACGGAGATCCGCGACAAGGAGAAGAAGGAGTACGCCCTGTTCTACCGCCCCGACGTCG
TGCCGCTGGACGAGACGAACAACACCCTCGAAGTACAGGCTGATCAACTGCAACACCTCCGCGGTCACGCAGGCGTGCCCCAA
GGTCACGTTCGAGCCCATCCCCATCCACTACTGCGCCCCCGCCGGCTACGCCATCCTGAAGTGCAACGACGAGACCTTCAAC
GGGACCGGCCCGTGCAGCAAGGTGTCCACCGTGCAGTGCACGCACGGCATCCGGCCCGTGGTGTCCACGCAGCTGCTCCTGA
ACGGGTCGCTGGCGGAGAAGGAGATCGTCATCCGGTCCGAGAACCTCACGAACAACGCGAAGATCATCATCGTGCACCTGCA
CACGCCGGTGGAGATCGTGTGCACCCGCCCGTACAACAACACGCGCAAGTCCGTCCGGATCGGCCCTGGCCAGACCTTCTAC
GCCACCGGCGACATCATCGGCAACCCGCGGCAGGCCCACTGCAACATCTCGAAGGAGATCTGGAACAAGACCCTGCAGGAGG
TGGGCAAGGAGCTGCAGAAGCACTTCCCCAACAAGACCATCCGGTACAACCAGTCGGCCGGCGGCGACATGGAGATCACCAC
GCACTCCTTCAACTGCGGTGGCGAGTTCTTCTACTGCAACACGTCCAACCTGTTCAACTCGACGTACAACGACACCTACATC
TCCCCGAACTCGACCAACTCCACGTCCACCATCACGCTCCAGTGCCGCATCAAGCAGATCATCAACATGTGGCAGGGGGTGG
GCCGCGCTATGTACGCACCGCCCATCGCCGGCAACATCACCTGCAAGTCCAACATCACCGGCCTCCTGCTGACCCGCGACGG
CGGCATCAACAACGTGTCGAACGAGACGGAGACCTTCAGGCCAGCGGGAGGCGACATGCGCGACAACTGGCGCTCCGAGCTG
TACAAGTACAAGGTGGTGGAGGTCCAGCCCCTGGGCCTCGCACCCACCGGGGCCAAGgagCGGGTCGTGGAGCGCGAGAAGg
agTAGTAAGaattcggtcaccaggtcccggatcc
>HV1300953_CH848.3.d0794.5.27D11gp120
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCCGGGCCTA
CGAGAAGGAGGTGCACAACGTGTGGGCGACCCACGCCTGCGTGCCCACGGACCCCAGCCCGCAGGAGCTCGTCCTGGGCAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCACGGTGGACAACCGCACCGTCGGCGA
GATGAAGAACTGCTCCTTCAACACGACGACGGAGATCCGCGACAAGGAGAAGAAGGAGTACGCCCTGTTCTACCGCCCGGAC
ATCGTGCCGCTGTCCGAGACCAACAACACCCTCGGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACAACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGAACACGCCCGTGGAGATCGTGTGCACCCGCCCGAACAACAACACGCGCAAGTCGTCCGGATCGGCCCTGGCCAGACCTT
CTACGCCACCGGCGACATCATCGGCGAGATCAAGCAGGCCCACTGCAACATCAGCGGAGAAGTGGAACGAGACCCTGCAG
AAGGTGGGCAAGGAGCTGCAGAAGCACTTCCCCAACAAGATCATTAAGTACGCCCAGTCGGCCGGCGGCGACATGGAGATCA
CCACGCACTCCTTCAACTGCGGTGGCGAGTTCTTCTACTGCAACACGGCGAACCTGTTCAACGGCACGTACAACGGCACCGA
```

Figure 5 continued

```
CATCTCCACGAACTCGTCCACCAAGTCGAACAGCACGATCACGCTCCAGTGCCGCATCAAGCAGATCATCAACATGTGGCAG
GGGGTGGGCCGCGCTATGTACGCACCGCCCATCGCCGGCAACATCACCTGCCGGTCCACCATCACCGGCCTCCTGCTGACCC
GCGACGGCGGCACGAACTCGAGCAAGACGGAGGAGGAGACGTTCAGGCCAGCGGGAGGCGACATGCGCGACAACTGGCGCTC
CGAGCTGTACAAGTACAAGGTGGTGGAGATCCAGCCCCTGGGCATCGCACCCACCGGGGCCAAGgagCGGGTCGTGGAGCGC
GAGAAGgagTAGTAAGaggacccgaattcggttaccggatcc
>HV1300954_CH848.3.d1432.5.41D11gp120
GgtcgacaagaaGCCACCATGCGCGTGACGGGCATCCTGCGGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCGACCACGGAGGA
GATGTCCACCGCCCTCGTGAAGAACTCCACGACCGAGGCGATGAAGAACTGCTCCTTCAACACCACGACGGAGATCCGCGAC
AAGGAGAAGAAGGAGTACGCCCTGTTCTACCGCCCCGACATCGTGCCGCTGAACAACGAGACGGGGAACATCTCCGAGTACA
GGCTGATCAACTGCAACACCTCCGCGGTCACGCAGGCGTGCCCCAAGGTCACGTTCGAGCCCATCCCCATCCACTACTGCGC
CCCCGCCGGCTACGCCATCCTGAAGTGCAACGACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGAAGGAGGAGATCGTCATCCGGT
CCGAGAACCTCACGAACAACGCGAAGATCATCATCGTGCACCTGCACACGCCGGTGGAGATCGTGTGCACCCGCCGGAACAA
CAACACGCGCAAGTCCGTGCGGATCGGCCCTGGCCAGACCTTCTACGCCACCGGCGACATCATCGGCGACCCGCGGAAGGCC
CACTGCAACATCTCGGAGAAGGACTGGAACAAGACCCTGCAGGAGGTGGGCAAGGAGCTGCAGAAGCACTTCCCCAACAAGA
CCATCCGGTACAACCAGTCGGCCGGCGGCGACATGGAGATCACCACGCACTCCTTCAACTGCGGTGGCGAGTTCTTCTACTG
CAACACGTCGAAGCTGTTCAACTCGACGTACAACGACACCTACATCTCCACGAACTCGTCCGCCAACAACTCGTCCACGATC
ACGCTCCAGTGCCGCATCAAGCAGATCATCAACATGTGGCAGGGGGTGGGCCGCGCTATGTACGCACCGCCCATCGCCGGCA
ACATCACCTGCAAGTCCAACATCACCGGCCTCCTGCTGACCCGCGACGGCGGCCCGGACTCGAACGAGACGGAGACCTTCAG
GCCAGCGGGAGGCGACATGCGCGACAACTGGCGCTCCGAGCTGTACAAGTACAAGGTGGTGGAGGTCCAGCCCCTGGGCATC
GCACCCACCGGGGCCAAGgagCGGGTCGTGGAGCGCGAGAAGgagTAGTAAGaattcggtcaccgggtcctggatcc
>HV1300955_CH848.3.d1432.5.50D11gp120
GgtcgacaagaaGCCACCATGCGCGTGACGGGCATCCTGAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGACCGCCACGGTGAACAACTCCACGGTGGACGA
GATGAAGAACTGCTCCTTCAACGCCACGACGGAGATCCGCGACAAGAAGAAGAAGGAGTACGCCCTGTTCTACCGCTCGGAC
GTCGTGCCGCTGGACGAGACGAACAACACGTCCGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACGACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGATCATCATCGTGCACC
TGCACACGCCGGTGGAGATCGTGTGCACCCGCCCGGGCCACAACACGCGCAAGTCCGTGCGGATCGGCCCTGGCCAGACCTT
CTACGCCACCGGCGACATCATCGGCGACATCCGGCAGGCCCACTGCAACATCAACGAGTCGAAGTGGAACGAGACCCTGCAG
AAGGTGGGCAACGAGCTGCAGAAGCACTTCCCCAACAAGACCATCAAGTACGAGCAGGCGGCCGGCGGCGACATGGAGATCA
CCACGCACTCCTTCAACTGCGGTGGCGAGTTCTTCTACTGCAACACGGCCAACCTGTTCAACGGCACGTACAACGGGACCGA
CATCTCCACGAACTCGTCCGCCAACTCGACGTCCACGATCACGCTCCAGTGCAAGATCAAGCAGATCATCAACATGTGGCAG
GGGGTGGGCCGCGCTATGTACGCACCGCCCATCGCCGGCAACATCACCTGCCGCTCCAACATCACCGGCCTCCTGCTGACCC
GCGACGGCGGCATCAACAACGTGTCGAACGAGACGGAGACCTTCAGGCCAGCGGGAGGCGACATGCGCGACAACTGGCGCTC
CGAGCTGTACAAGTACAAGGTGGTGGAGGTCCAGCCCCTGGGCATCGCACCCACCGGGGCCAAGgagCGGGTCGTGGAGCGC
GAGAAGgagTAGTAAGaattcggtaaccgggtcccggatcc
>HV1300956_CH848.3.d1432.5.56D11gp120
GgtcgacaagaaGCCACCATGCGCGTGACGGGCATCCTGAAGAACTACCCGCGGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCGACCACGGAGGA
GATGTCCAACGCCACGGTGAAGAACTCCACGACGGAGATGAAGAACTGCTCCTTCAACACCACGACGGAGATCCGCGAC
AAGGAGAAGAAGGAGTACGCCCTGTTCTACCGCCCCGACGTCGTGCCGCTGGACGAGACGAACAACACGTCCAAGTACAGGC
TGATCAACTGCAACACCTCCGCGGTCACGCAGGCGTGCCCCAAGGTCACGTTCGAGCCCATCCCCATCCACTACTGCGCCCC
CGCCGGCTACGCCATCCTGAAGTGCAACGACGAGACCTTCAACGGGACCGGCCCGTGCAGCAACGTGTCCACCGTGCAGTGC
```

Figure 5 continued

```
ACGCACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGCACACGCCGGTGGAGATCGTGTGCACCCGCCCGTACAACAA
CACGCGCAAGTCCGTGCGGATCGGCCCTGGCCAGACCTTCTACGCCACCGGCGACATCATCGGCGACCCGCGGCAGGCCCAC
TGCAACATCTCGAAGGAGATCTGGAACAAGACCCTGCAGGAGGTGGGCAAGGAGCTGCAGAAGCACTTCCCCAACAAGACCA
TCCGCTACAACCAGTCCGCCGGCGGCGACATGGAGATCACCACGCACTCCTTCAACTGCGGTGGCGAGTTCTTCTACTGCAA
CACGGCCAAGCTGTTCAACTCCACGTACAACGACACCTACAAGTCCACGAACTCGTCCGCCAACAACTCGTCCATCATCACG
CTCCAGTGCCGGATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCATCAACAACGTGTCGAACGAGACGGAGACCTT
CAGGCCAGCGGGAGGCGACAACTGGCGCTCCGAGCTGTACAAGTACAAGGTGGTGGAGGTCCAGCCCCTGGGCATCGCACCC
ACCGGGGCCAAGgagCGGGTCGTGGAGCGCGAGAAGgagTAGTAAGaattcggtaaccaggacccggatcc
>HV1300957_CH848.3.d1621.4.12D11gp120
GgtcgacaagaaGCCACCATGCGCGTGACGGGCATCCTGAAGAACTACCCGCGGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCAGCCCGCAGGAGCTCTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGCCACGGTCAACTCCACCACCGACTACGA
CTCCCGGTCCAACGACACCGTGACCAACATCACGAACACGATCAAGGAGGAGGTGAAGAACTGCTCCTTCAAGACCACGACG
GAGATCCGCGACAAGGAGAAGAAGGAGCACGCCCTGTTCTACCGCCCCGACATCGTGCCGCTGAACTCCGAGACGGGCAACA
CGTCCGAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACGACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCGAAGGAGGAGA
TCGTCATCCGGTCCGAGAACCTCACGAACAACGCGAAGACCATCATCGTGCACCTGCACACGCCGGTGGAGATCGTGTGCAC
CCGCCCGGGCAACAACACGCGCAAGTCCATGCGGATCGGCCCTGGCCAGACCTTCTACGCCACCGGCGACATCATCGGCGAC
ATCCGGCAGGCCCACTGCAACATCTCGGAGGAGAAGTGGAACAAGACCCTGCAGGAGGTGGGCAAGGAGCTGCAGAAGCACT
TCCCCAACCGGACCATCAAGTACAACCAGTCCGCCGGCGGCGACATGGAGATCACCACGCACTCCTTCAACTGCGGTGGCGA
GTTCTTCTACTGCAACACGTCCAAGCTGTTCAACTCCACGTACAACGACACCTACATCTCCACGAACTCGACCAACTCGTCC
GCCAACAACTCGTCCATCATCACGCTCCAGTGCCGGATCAAGCAGATCATCAACATGTGGCAGGGGGTGGGCCGCGCTATGT
ACGCACCGCCCATCGCCGGCAACATCATCTGCAAGTCCAACATCACCGGCCTCCTGCTGACCCGCGACGGCGGCCCGGACTC
GAACAAGACGGAGACCTTCAGGCCAGCGGGAGGCGACATGCGGGACAACTGGCGCTCCGAGCTGTACAAGTACAAGGTGGTG
GAGGTCCAGCCCCTGGGCATCGCACCCACCGGGGCCAAGgagCGGGTCGTGGAGCGCGAGAAGgagTAGTAAGaattcggta
accaggtcccggatcc
>HV1300958_CH848.3.d1621.4.15D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCAACCCGCAGGAGATGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGCCACGGTCAACTCCACCACCGACTACGA
CTCCCGGTCCAACGACTCCGTGACCAACATCACGAACACGATCAAGGAGGAGGTGAAGAACTGCTCCTTCAAGACCACGACG
GAGATCCGCGACAAGGAGAAGAAGGAGCACGCCCTGTTCTACCGCCCCGACATCGTGCCGCTCAACTCCGAGACGGGCAACA
TCTCCGAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACGACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCGAAGGAGGAGA
TCGTCATCCGGTCCGAGAACCTCACGAACAACGCGAAGATCATCGTGCAGCTGAACACGTCCGTGGAGATCGTGTGCAC
CCGCCCGGGCAACAACACGCGCAAGTCCGTGCGGATCGGCCCTGGCCAGACCTTCTACGCCACCGGCGACATCATCGGCGAC
ATCCGGCAGGCCCACTGCAACATCTCGGAGAAGAAGTGGAACGAGACCCTGCAGCGGGTGGGCATCGAGCTGCAGAAGCACT
TCCCCAACAAGACCATCAAGTACAACCAGTCCGCCGGCGGCGACATGGAGATCACCACGCACTCCTTCAACTGCGGTGGCGA
GTTCTTCTACTGCAACACGGCCAAGCTGTTCAACTCCACGTACAACGGCACCTACATCAACACGACCTCGATCAACTCGACC
CTCAACATCACGCTCCAGTGCCGGATCAAGCAGATCATCAACATGTGGCAGGGGGTGGGCCGCGCTATGTACGCACCGCCCA
TCGCCGGCAACATCACCTGCCGGTCCAACATCACCGGCCTCCTGCTGACCCGCGACGGCGGCATCCACAACGACTCGAACGA
GACGGAGACCTTCAGGCCAGCGGGAGGCGACATGCGGGACAACTGGCGCTCCGAGCTGTACAAGTACAAGGTGGTGGAGGTC
CAGCCCCTGGGCATCGCACCCACCGGGGCCAAGgagCGGGTCGTGGAGCGCGAGAAGgagTAGTAAGaattcggtaaccggg
acctggatcc
>HV1300959_CH848.3.d1621.4.25D11gp120
GgtcgacaagaaGCCACCATGCGCGTGACGGGCATCCTGAAGAACTACCCGCAGTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
```

Figure 5 continued

CGAGAAGGAGGTGCACAACGTGTGGGCGACCCACGCCTGCGTGCCCACGGACCCCAGCCCGCAGGAGCTCTTCCTGGAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGACCGCCACGGTGAACAACTCCACGGTGGACGA
GATGAAGAACTGCTCCTTCAACGCCACGACGGAGATCCGCGACAAGAAGAAGAAGGAGTACGCCCTGTTCTACCGCTCGGAC
GTCGTGTCCCTGGACGAGACGAACAACACGTCCGAGTACAGGCTGATCAACTGCAACACCTCCGCGGTCACGCAGGCGTGCC
CCAAGGTCACGTTCGAGCCCATCCCCATCCACTACTGCGCCCCCGCCGGCTACGCCATCCTGAAGTGCAACGACGAGACCTT
CAACGGGACCGGCCCGTGCAGCAACGTGTCCACCGTGCAGTGCACGCACGGCATCCGGCCCGTGGTGTCCACGCAGCTGCTC
CTGAACGGGTCGCTGGCGGAGAAGGAGATCGTCATCCGGTCCGAGAACCTCACGAACAACGCGAAGACGATCATCGTGCACC
TGCACGCCCCGGTGGAGATCGTGTGCACCCGCCCGGGCCACAACACGCGCAAGTCCGTGCGGATCGGCCCTGGCCAGACCTT
CTACGCCACCGGCGACATCATCGGCAACATCCGGCAGGCCCACTGCAACATCAACGAGTCGGAGTGGAACGAGACCCTGCAG
AAGGTGGGCAAGGAGCTGCGCAAGCACTTCCCCAACAAGACCATCAAGTACGAGCAGTCCGCCGGCGGCGACATGGAGATCA
CCACGCACTCCTTCAACTGCGGTGGCGAGTTCTTCTACTGCAACACGGCCAACCTGTTCAACGGCACGTACAACGGGACCGA
CATCTCCACGAACTCGTCCGCCGACCGCAACTCCACGATCACGCTCGAGTGCAAGATCAAGCAGATCATCAACATGTGGCAG
GGGGTGGGCCGCGCTATGTACGCACCGCCCATCGCCGGCAACATCACCTGCCGCTCCAACATCACCGGCCTCCTGCTGACCC
GCGACGGCGGCATCAACAACGTGTCGAACGCCACGGAGACCTTCAGGCCAGCGGGAGGCGACATGCGCGACAACTGGCGCTC
CGAGCTGTACAAGTACAAGGTGGTGGAGGTCCAGCCCCTGGGCATCGCACCCACCGGGGCCAAGgagCGGGTCGTGGAGCGC
GAGAAGgagTAGTAAGaattcggtaaccgggtcctggatcc
>HV1300960_CH848.3.d1621.4.31D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCCAACGCCACCGT
CGAGAACTCCACGGAGGCCATGAAGAACTGCTCCTTCAACACCACGACGGAGATCCGCGACAAGATCAAGAAGGAGCGGGCC
CTGTTCTACCGCCCCGACATCGTGCCGCTCAACGACGAGACGAACAACACCTCCAAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACGACGAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCGGAGAAGGAGATCGTCATCCGGTCCGAGAACCTCACGAACAACG
CGAAGATCATCATCGTGCACCTGCACACGCCGGTGCAGATCGTGTGCACCCGCCCGTACAACAACACGCGCAAGTCCGTGCG
GATCGGCCCTGGCCAGACCTTCTACGCCACCGGCGACATCATCGGCGACCCGCGGAAGGCCCACTGCAACATCTCGGAGAAG
GACTGGAACAAGACCCTGCAGGAGGTGGGCAAGGAGCTGCAGAAGCACTTCCCCAACAAGACCATCCGGTACAACCAGTCCG
CCGGCGGCGACATGGAGATCACCACGCACTCCTTCAACTGCGGTGGCGAGTTCTTCTACTGCAACACGTCCAAGCTGTTCAA
CTCCACGTACAACGACACCTACATCTCCACGAACTCGACCAACTCGTCGGCCAACAACTCGTCCATCATCACGCTCCAGTGC
CGGATCAAGCAGATCATCAACATGTGGCAGGGGGTGGGCCGCGCTATGTACGCACCGCCCATCGCCGGCAACATCACCTGCA
AGTCCAACATCACCGGCCTCCTGCTGACCCGCGACGGCGGCCCGACAACAAGACGGAGACCTTCAGGCCAGCGGGAGGCGA
CATGCGGGACAACTGGCGCTCCGAGCTGTACAAGTACAAGGTGGTGGAGGTCCAGCCCCTGGGCATCGCACCCACCGGGGCC
AAGgagCGGGTCGTGGAGCGCGAGAAGgagTAGTAAGaattcggttaccgggtcccggatcc
>HV1300961_CH848.3.d1621.4.44D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCCACGACCGAGAA
GATGTCCAACGTCACCGTCAACAACATCACCATCGAGGAGATGAAGAACTGCTCCTTCAACACCACGACGGAGATCCGCGAC
AAGATCAAGAAGGAGCGGGCCCTGTTCTACCGCCCCGACATCGTGCCGCTGAACGACGAGACGAACAACACCTCCAAGTACA
GGCTGATCAACTGCAACACCTCCGCGGTCACGCAGGCGTGCCCCAAGGTCACGTTCGAGCCCATCCCCATCCACTACTGCGC
CCCCGCCGGCTACGCCATCCTGAAGTGCAACGACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGAGATCGTCATCCGGT
CCGAGAACCTCACGAACAACGCGAAGATCATCATCGTGCACCTGCACGCCCCGGTGGAGATCGTGTGCACCCGCCCGTACAA
CAACACGCGCAAGTCCGTGCGGATCGGCCCTGGCCAGACCTTCTACGCCACCGGCGACATCATCGGCGACCCGCGGCAGGCC
CACTGCAACATCTCGAAGGAGATCTGGAACAAGACCCTGCAGGAGGTGGGCAAGGAGCTGCAGAAGCACTTCCCCAACAAGA
CCATCCGGTACAACCAGTCCGCCGGCGGCGACATGGAGATCACCACGCACTCCTTCAACTGCGGTGGCGAGTTCTTCTACTG
CAACACGTCCAACCTGTTCAACTCCACGTACAACGACACCTACATCTCCCCCAACTCGACCAACTCGACGTCCATCATCACG
CTCCAGTGCAAGATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCATCAACAACGTGTCCAACGAGACGGAGACCTT

Figure 5 continued

```
CAGGCCAGCGGGAGGCGACATGCGGGACAACTGGCGCTCCGAGCTGTACAAGTACAAGGTGGTGGAGGTCCAGCCCCTGGGC
ATCGCACCCACCGGGGCCAAGgagCGGGTCGTGGAGCGCGAGAAGgagTAGTAAGaattcggttaccaggacccggatcc
>HV1300962_CH848.3.d1621.4.46D11gp120
GgtcgacaagaaGCCACCATGCGCGTGATGGGCATCCTGAAGAACTACCCGCGGTGGTGGATCTGGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCTCGCCGCAGGAGCTGGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGCCATCGTCAAGAACTCCACGACCGAGGA
GCTGTCCAACGCCCTCGCGCGGAACTCGACCACCGAGGAGATGAAGAACTGCTCCTTCAACACCACGACGGAGATCCGCGAC
AAGGAGAAGAAGGAGTACGCCCTGTTCTACCGCCCCGACATCGTGCCGCTGAACAACAAGACGTCCAACATCTCCGAGTACA
GGCTGATCAACTGCAACACCTCCACCGTCACGCAGGCGTGCCCCAAGGTCACGTTCGAGCCCATCCCCATCCACTACTGCGC
CCCCGCCGGCTACGCCATCCTGAAGTGCAACAACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGAAGGAGGGCATCGTCATCCGGT
CCGAGAACCTCACGAACAACGCGAAGATCATCATCGTGCAGCTGAACGCCAACGCCTCGGTGGAGATCGTGTGCACCCGCCC
GAACAACAACACGCGCAAGTCCGTGCGGATCGGCCCTGGCCAGACCTTCTACGCCACCGGCGACATCATCGGCAACATCCGG
CAGGCCCACTGCAACATCTCGGAGAAGAAGTGGAACGAGACCCTGCAGAAGGTGGGCATCGAGCTGCAGAAGCACTTCCCCA
ACAAGACCATCAAGTACAACCAGTCCGCCGGCGGCGACATGGAGATCACCACGCACTCCTTCAACTGCGGTGGCGAGTTCTT
CTACTGCAACACGGCCAAGCTGTTCAACTCCACGTACAACGGCACCTACATCTCCACGAACTCGATCAACTCGACGCTGAAC
ATCACGCTCCAGTGCCGGATCAAGCAGATCATCAACATGTGGCAGGGGGTGGGCCGCGCTATGTACGCACCGCCCATCGCCG
GCAACATCACCTGCCGGTCCAACATCACCGGCCTCCTGCTGACCCGCGACGGCGGCATCCACAACGACTCCAACGAGACGGA
GACCTTCAGGCCAGCGGGAGGCGACATGCGGGACAACTGGCGCTCCGAGCTGTACAAGTACAAGGTGGTGGAGATCCAGCCC
CTGGGCATCGCACCCACCGGGGCCAAGgagCGGGTCGTGGAGCGCGAGAAGgagTAGTAAGaattcggttaccaggtcccgg
atcc
>HV1300963_CH848.3.d1635.10.35D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCCACGACCGAGGA
GATCAGCAACGCCACCGTCAAGAACATCACCATCAAGGAGATGAAGAACTGCTCCTTCAACACCACGACGGAGATCCGCGAC
AAGATCAAGAAGGAGCGGGCCCTGTTCTACCGCACCGACATCGTGCCGCTGAACAAGGAGACGGGCAACATCTCCGAGTACA
GGCTGATCAACTGCAACACCTCCGCGGTCACGCAGGCGTGCCCCAAGGTCACGTTCGAGCCCATCCCCATCCACTACTGCGC
CCCCGCCGGCTACGCCATCCTGAAGTGCAACGACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGAGATCGTCATCCGGT
CCGAGAACCTCACGAACAACGCGAAGATCATCATCGTGCACCTGCACAACCCGGTGGAGATCGTGTGCACCCGCCCGTACAA
CAACACGCGCAAGTCCGTGCGGATCGGCCCTGGCCAGACCTTCTACGCCACCGGCGACATCATCGGCGACCCGCGGCAGGCC
CACTGCAACATCTCGAAGGAGGAGTGGAACAAGACCCTGCAGGAGGTGGGCAAGGAGCTGCAGAAGCACTTCCCCAACAAGA
CCATCCGGTACAACCAGTCCGCCGGCGGCGACATGGAGATCACCACGCACTCCTTCAACTGCGGTGGCGAGTTCTTCTACTG
CAACACGTCCAACCTGTTCAACTCCACGTACAACGACACCTACATCTCCCCCAACTCGACCAACTCGACGTCCATCATCACG
CTCCAGTGCCGGATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCATCAACAACGTGTCCAACGAGACGGAGACCTT
CAGGCCAGCGGGAGGCGACATGCGGGACAACTGGCGCTCCGAGCTGTACAAGTACAAGGTGGTGGAGGTCCAGCCCCTGGGC
ATCGCACCCACCGGGGCCAAGgagCGGGTCGTGGAGCGCGGCAAGgagTAGTAAGaattcggttaccgggacctggatcc
>HV1300964_CH848.3.d1651.7.34D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCCACGACCGAGAA
GATGAGCAACGTCACCGTCAACAACATCACCATCGAGGAGATGAAGAACTGCTCCTTCAACACCACGACGGAGATCCGCGAC
AAGATCAAGAAGGAGCGGGCCCTGTTCTACCGCCCCGGACATCGTGCCGCTGAACGACGAGACGAACAACACCTCCAAGTACA
GGCTGATCAACTGCAACACCTCCGCGGTCACGCAGGCGTGCCCCAAGGTCACGTTCGAGCCCATCCCCATCCACTACTGCGC
CCCCGCCGGCTACGCCATCCTGAAGTGCAACGACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGAGATCGTCATCCGGT
CCGAGAACCTCACGAACAACGTGAAGACCATCATCGTGCACCTGCACGCCCCGGTGGAGATCGTGTGCACCCGCCCGTACAA
```

Figure 5 continued

```
CAACACGCGCAAGTCCGTGCGGATCGGCCCTGGCCAGACCTTCTACGCCACCGGCGACATCATCGGCGACCCGCGGAAGGCC
CACTGCAACATCTCGGAGAAGGACTGGAACAAGACCCTGCAGGAGGTGGGCAAGGAGCTGCAGAAGCACTTCCCCAACAAGA
CCATCCGGTACAACCAGTCCGCCGGCGGCGACATGGAGATCACCACGCACTCCTTCAACTGCGGTGGCGAGTTCTTCTACTG
CAACACGTCCAAGCTGTTCAACTCCACGTACAACGACACCTACATCTCCACCAACTCGACCAACTCGTCGGCCAACAACTCG
TCCATCATCACGCTCCAGTGCCGGATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCCCGGACAACAAGACGGAGAC
CTTCAGGCCAGCGGGAGGCGACATGCGGGACAACTGGCGCTCCGAGCTGTACAAGTACAAGGTGGTGGAGGTCCAGCCCCTG
GGCATCGCACCCACCGGGGCCAAGgagCGGGTCGTGGAGCGCGAGAAGgagTAGTAAGaattcggttaccgggtcctggatc
c
>HV1300965_CH848.3.d1651.7.50D11gp120
GgtcgacaagaaGCCACCATGCGCGTGATGGGCATCCTGAAGAACTACCCGCGGTGGTGGATCTGGGCATCCTGGGCTTCT
GGATGCTCATGATCTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCTCGCCGCAGGAGCTGGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGCCATCGTCAAGAACTCCACGACCGAGGA
GCTGTCCAACGCCCTCGCGCGGAACTCGACCACCGAGGAGATGAAGAACTGCTCCTTCAACACCACGACGGAGATCCGCGAC
AAGGAGAAGGAGGAGTACGCCCTGTTCTACCGCCCCGACATCGTGCGCGCTGAACAACAAGACGTCCAACATCTCCGAGTACA
GGCTGATCAACTGCAACACCTCCACCGTCACGCAGGCGTGCCCCAAGGTCACGTTCGAGCCCATCCCCATCCACTACTGCGC
CCCCGCCGGCTACGCCATCCTGAAGTGCAACAACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGGCATCGTCATCCGGT
CCGAGAACCTCACGAACAACGCGAAGATCATCATCGTGCAGCTGAACGCCAACGCCTCGGTGGAGATCGTGTGCACCCGCCC
GAACAACAACACGCGCAAGTCCGTGCGGATCGGCCCTGGCCAGACCTTCTACGCCACCGGCGACATCATCGGCAACATCCGG
CAGGCCCACTGCAACATCTCGGAGAAGAAGTGGAACGAGACCCTGCAGAAGGTGGGCATCGAGCTGCAGAAGCACTTCCCCA
ACAAGACCATCAAGTACAACCAGTCCGCCGGCGGCGACATGGAGATCACCACGCACTCCTTCAACTGCGGTGGCGAGTTCTT
CTACTGCAACACGACCAAGCTGTTCAACTCCACGTACAACGGCACCTACATCTCCACGAACTCGATCAACTCGACGCTGAAC
ATCACGCTCCAGTGCCGGATCAAGCAGATCATCAACATGTGGCAGGGGATCGGCCGCGCTATGTACGCACCGCCCATCGCCG
GCAACATCACCTGCCGGTCCAACATCACCGGCCTCCTGCTGACCCGCGACGGCGGCATCCACAACGACTCCAACGAGACGGA
GACCTTCAGGCCAGCGGGAGGCGACATGCGGGACAACTGGCGCTCCGAGCTGTACAAGTACAAGGTGGTGGAGATCCAGCCC
CTGGGCATCGCACCCACCGGGGCCAAGgagCGGGTCGTGGAGCGCGGGAAGgagTAGTAAGgtgaccgggacccgaattcgg
atcc
>HV1300966_CH848.3.d1651.10.04D11gp120
GgtcgacaagaaGCCACCATGCGCGTGACGGGCATCCTGAAGAACTGCCCGCTCTGGTGGATCTGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGATCTGCTCGAACGCCATCGTCAAGAACTCCAACGCCACGGT
CGAGAACTCCACGGAGGCCATGAAGAACTGCTCCTTCAACACCACGACGGAGATCCGCGACAAGATCAAGAAGGAGCGGGCC
CTGTTCTACCGCCCCGACATCGTGCCGCTCAACAACGAGACGGGCAACATCTCCGAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACGACGAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCGGAGAAGGAGATCGTCATCCGGTCCGAGAACCTCACGAACAACG
CGAAGATCATCATCGTGCACCTGCACAACCCGGTGGAGATCGTGTGCACCCGCCCGTACAACAACACGCGCAAGTCCGTGCG
GATCGGCCCTGGCCAGACCTTCTACGCCACCGGCGACATCATCGGCGACCCGCGGAAGGCCCACTGCAACATCTCGAAGGAG
GAGTGGAACAAGACCCTGCAGGAGGTGGGCAAGGAGCTGCAGAAGCACTTCCCCAACAAGACCATCCGGTACAACCAGTCCG
CCGGCGGCGACATGGAGATCACCACGCACTCCTTCAACTGCGGTGGCGAGTTCTTCTACTGCAACACGTCCAACCTGTTCAA
CTCCACGTACAACGACACCTACATCTCCCCGAACTCGACCAACTCGACCTCCATCATCACGCTCCAGTGCCGGATCAAGCAG
ATCATCAACATGTGGCAGGGGGTGGGCCGCGCTATGTACGCACCGCCCATCGCCGGCAACATCACCTGCAAGTCCAACATCA
CCGGCCTCCTGCTGACCCGCGACGGCGGCCCCGAGTCCAACGAGACGGAGACCTTCAGGCCAGCGGGAGGCGACATGCGGGA
CAACTGGCGCTCCGAGCTGTACAAGTACAAGGTGGTGGAGGTCCAGCCCCTGGGCATCGCACCCACCGGGGCCAAGgagCGG
GTCGTGGAGCGCGAGAAGgagTAGTAAGgtcaccgggacccgaattcggatcc
>HV1300967_CH848.3.d1677.521.D11gp120
GgtcgacaagaaGCCACCATGCGCGTGACGGGCATCCTGAAGAACTGCCCGCTCTGGTGGATCTGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CAAGAAGGAGGTGCACAACGTGTGGGCGACCCACGCCTGCGTGCCCACGGACCCCTCGCCGCAGGAGCTGTTCCTGAAGAAC
GTGACCGAGAACTTCAACATGTGGAAGAACGACATGGTGGACCAGATGCACGAGGACATCATCTCCCTGTGGGACCAGTCCC
```

Figure 5 continued

```
TGAAGCCCTGCGTGAAGCTGACCCCGCTGTGCGTGACCCTGATCTGCTCGAACGCCATCGTCAAGAACTCCAACGCCACCGT
CGGGAACTCCACGGAGGCCATGAAGAACTGCTCCTTCAACACCACGACGGAGATCCGCGACAAGATCAAGAAGGAGCGGGCC
CTGTTCTACCGCCCCGACATCGTGCCGCTGAACGACGAGACGAACAACACCTCCAAGTACAGGCTGATCAACTGCAACACCT
CCGCGGTCACGCAGGCGTGCCCCAAGGTCACGTTCGAGCCCATCCCCATCCACTACTGCGCCCCCGCCGGCTACGCCATCCT
GAAGTGCAACGACGAGACCTTCAACGGGACCGGCCCGTGCAGCAACGTGTCCACCGTGCAGTGCACGCACGGCATCCGGCCC
GTGGTGTCCACGCAGCTGCTCCTGAACGGGTCGCTGGCGGAGAAGGAGATCGTCATCCGGTCCGAGAACCTCACGAACAACG
TGAAGATCATCATCGTGCACCTGCACACGCCGGTGCAGATCGTGTGCACCCGCCCGTACAACAACACGCGCAAGTCCGTGCG
GATCGGCCCTGGCCAGACCTTCTACGCCACCGGCGACATCATCGGCGACCCGCGGAAGGCCCACTGCAACATCTCGGAGAAG
GACTGGAACAAGACCCTGCAGGAGGTGGGCAAGGAGCTGCAGAAGCACTTCCCCAACAAGACCATCCGGTACAACCAGTCCG
CCGGCGGCGACATGGAGATCACCACGCACTCCTTCAACTGCGGTGGCGAGTTCTTCTACTGCAACACGTCCAAGCTGTTCAA
CTCCACGTACAACGACACCTACATCTCCACGAACTCGACCAACTCGTCGGCCAACAACTCGTCCATCATCACGCTCCAGTGC
CGGATCAAGCAGATCATCAACATGTGGCAGGGGGTGGGCCGCGCTATGTACGCACCGCCCATCGCCGGCAACATCACCTGCA
AGTCCAACATCACCGGCCTCCTGCTGACCCGCGACGGCGGCCCCGACAACAAGACGGAGACCTTCAGGCCAGCGGGAGGCGA
CATGCGGGACAACTGGCGCTCCGAGCTGTACAAGTACAAGGTGGTGGAGGTCCAGCCCCTGGGCATCGCACCCACCGGGGCC
AAGgagCGGGTCGTGGAGCGCGAGAAGgagTAGTAAGgtaaccgggacccgaattcggatcc
>HV1300968_CH848.3.d1720.5D11gp120
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcgtgCCGGTGTGGAAGGAGGCCAAGACGACCCTGTTCTGCGCGTCGGACGCCAAGGCCTA
CGTGAAGGAGGTGCACAACGTGTGGGCGACCCACGCCTGCGTGCCCACGGACCCCTCGCCGCAGGAGCTGGTCCTGGACAAC
GTGACCGAGAACTTCAACATGTGGAAGAACGACATGGTGGACCAGATGCACGAGGACATCATCTCCCTGTGGGACCAGTCCC
TGAAGCCCTGCGTGAAGCTGACCCCGCTGTGCGTGACCCTGAACTGCTCGAACGCCATCGTCCGGAACTCCACGACCGAGAA
GATGTCCGACGCGCTGGACCGCAACTCGACGACCGAGGAGATGAAGAACTGCTCCTTCAACACCACGACGGAGATCCGCGAC
AAGGAGAAGAAGGAGTACGCCCTGTTCTACCGCCCCGACATCGTGCCGCTGAACAACAAGACGTCCAACATCTCCGAGTACA
GGCTGATCAACTGCAACACCTCCACCGTCACGCAGGCGTGCCCCAAGGTCACGTTCGAGCCCATCCCCATCCACTACTGCGC
CCCCGCCGGCTACGCCATCCTGAAGTGCAACAACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGAAGGAGGAGATCGTCATCCGGT
CCGAGAACCTCACGAACAACGCCAAGATCATCATCGTGCAGCTGAACGCGAACGCCTCCGTGGAGATCGTGTGCACCCGCCC
GAACAACAACACGCGCAAGTCCGTGCGGATCGGCCCTGGCCAGACCTTCTACGCCACCGGCGACATCATCGGCGACATCCGG
CAGGCCCACTGCAACATCTCGGAGAAGAAGTGGAACGAGACCCTGCAGCAGGTGGGCATCGAGCTGCAGAAGCACTTCCCCA
ACAAGACCATCAAGTACAACCAGTCCGCCGGCGGCGACATGGAGATCACCACGCACTCCTTCAACTGCGGTGGCGAGTTCTT
CTACTGCAACACGGCCAAGCTGTTCAACTCCACGTACAACGGCACCTACATCTCCACGGACTCGATCAACTCGACCCTCAAC
ATCACGCTCCAGTGCCGGATCAAGCAGATCATCAACATGTGGCAGGGGGTGGGCCGCGCTATGTACGCACCGCCCATCGCCG
GCAACATCACCTGCCGGTCCAACATCACCGGCCTCCTGCTGACCCGCGACGGCGGCATCCACAACGACTCGAACGTGACGGA
GACCTTCAGGCCAGCGGGAGGCGACATGCGGGACAACTGGCGCTCCGAGCTGTACAAGTACAAGGTGGTGGAGATCCAGCCC
CTGGGCATCGCACCCACCGGGGCCAAGgagCGGGTCGTGGGGCGCGAGAAGgagTAGTAAGgttaccgggacccgaattcgg
atcc
>CH0848d0526.25.26D11gp120, HV1301011 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCT
TCCTGGAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGAACTGCTCGAACGTCAACGTGA
CGCGGTCGAACGTGAACGTCACGAACATCACGAACACGATCAAGGGCGAGATGAAGAACTGCTCCTTCAACACGACGA
CGGAGATCCGCGACAAGGAGAAGAAGGAGTACGCCCTGTTCTACCGCTCGGACGTGGTGCCGCTGAACGAGACCAGCA
ACACCTCGGAGTACAGGCTGATCAACTGCAACACCTCCGCGGTCACGCAGGCGTGCCCCAAGGTCACGTTCGAGCCCA
TCCCCATCCACTACTGCGCCCCCGCCGGCTACGCCATCCTGAAGTGCAACAACGAGACCTTCAACGGGACCGGCCCGT
GCAGCAACGTGTCCACCGTGCAGTGCACGCACGGCATCCGGCCCGTGGTGTCCACGCAGCTGCTCCTGAACGGGTCGC
TGGCGGAGAAGGAGATCGTCATCCGGTCCGAGAACCTCACGAACAACGCGAAGATCATCATCGTGCACCTGCACACGC
CCGTGGAGATCGTGTGCACCCGCCCGGGCAACAACACGCGCAAGTCCGTCCGGATCGGCCCTGGCCAGACCTTCTACG
CCACCGGCGACATCATCGGCGACATCCGCCAGGCCCACTGCAACATCAGCGAGGAGAAGTGGAACAAGACCCTGCACG
AGGTGTCGAAGGAGCTGCAGAAGCACTTCCCCAACAAGACGATTAAGTACGCGCAGTCGGCCGGCGGCGACATGGAGA
TCACCACGCACTCCTTCAACTGCGGTGGCGAGTTCTTCTACTGCAACACGTCGAACCTGTTCAACGGCACCTACAACG
GCACCTACATCTCGACGAACTCGTCCGCGAACTCCAACAGCACGATCACGCTCCAGTGCCGCATCAAGCAGATCATCA
ACATGTGGCAGGGGGTGGGCCGCGCTATGTACGCACCGCCCATCGCCGGCAACATCACCTGCCGCTCCAACATCACCG
```

Figure 5 continued

GCCTCCTGCTGACCCGCGACGGCGGCACCAAGAACAACAAGACGGAGGAGACCTTCAGGCCAGCGGGAGGCGACATGC
GCGACAACTGGCGCTCCGAGCTGTACAAGTACAAGGTGGTGGAGATCCAGCCCCTGGGCATCGCACCCACCGGGGCCA
AGgagCGGGTCGTGGAGCGCGAGAAGgagTAGTAAgggatcc >CH0848d0700.15.34D11gp120, HV1301012 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCG
TCCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
ACAACCGCACCATGGGGGAGATGAAGAACTGCTCCTTCAACACGACGACGGAGATCCGCGACAAGGAGAAGAAGGAGT
ACGCCCTGTTCTACAAGCCCGACGTCGTGCCGCTGGACGAGACCAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACAACGAGACCTTCAACGGCACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGAACACGCCCGTGGAGATCGTGTGCACCCGCCCGAACA
ACAACACGCGCAAGTCCGTCCGGATCGGCCCTGGCCAGACCTTCTACGCCACCGGCGGCATCATCGGCGACATCCGCC
AGGCCCACTGCAACATCAGCGAGGGGCAGTGGAACGAGACCCTGCAGAAGGTGGGCAAGGAGCTGCAGAAGCACTTCC
CCAACAAGACGATTAAGTACGAGCAGTCGGCCGGCGGCGACATGGAGATCACCACGCACTCCTTCAACTGCGGTGGCG
AGTTCTTCTACTGCAACACGTCGAAGCTGTTCAACGGCACGTACAACGGCACCTACATCTCCACGAACTCGTCCACCA
ACTCGACGAGCACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCACGA
ACAGCTCGGAGGAGATCTTCAGGCCAGCGGGAGGCGACATGCGCGACAACTGGCGCTCCGAGCTGTACAAGTACAAGG
TGGTGGAGATCCAGCCCCTGGGCATCGCACCCACCGGGGCCAAGgagCGGGTCGTGGAGCGCGAGAAGgagTAGTAAg
ggatcc >CH0848d0780.25.05D11gp120, HV1301013 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
ACAACCGCACCGACTACGACACGCGGTCCAACGTGAACGTGACCAACATCACGAACACGATCAAGGGGGAGATGAAGA
ACTGCTCCTTCAACACGACGACGGAGATCCGCGACAAGGAGAAGAAGGAGTACGCCCTGTTCTACCGCCCCGACATCG
TGCCGCTGAACGAGAACGAGACCAGCAACACCTCGGAGTACAGGCTGATCAACTGCAACACCTCCGCGGTCACGCAGG
CGTGCCCCAAGGTCACGTTCGAGCCCATCCCCATCCACTACTGCGCCCCCGCCGGCTACGCCATCCTGAAGTGCAACG
ACGAGACCTTCAACGGGACCGGCCCGTGCAGCAACGTGTCCACCGTGCAGTGCACGCACGGCATCCGGCCCGTGGTGT
CCACGCAGCTGCTCCTGAACGGGTCGCTGGCGGAGAAGGAGATCGTCATCCGGTCCGAGAACCTCACGAACAACGCGA
AGATCATCATCGTGCACCTGAACACGTCGGTGGAGATCGTGTGCACCCGCCCGGGCAACAACACGCGCAAGTCCGTCC
GGATCGGCCCTGGCCAGACCTTCTACGCCACCGGCGACATCATCGGCGACATCCGCCAGGCCCACTGCAACATCAGCG
AGTCGAAGTGGAACGAGACCCTGCAGAAGGTGGGCATCGAGCTGCAGAAGCACTTCCCCAACAAGACGATTAAGTACG
AGCAGTCGGCCGGCGGCGACATGGAGATCACCACGCACTCCTTCAACTGCGGTGGCGAGTTCTTCTACTGCAACACGT
CGAACCTGTTCAACGGCACGTACAACGGCACCTACATCTCCACGAACTCGTCCGCCAACTCGACGAGCACGATCACGC
TCCAGTGCCGCATCAAGCAGATCATCAACATGTGGCAGGGGGTGGGCCGCGCTATGTACGCACCGCCCATCGCCGGCA
ACATCACCTGCAAGTCCAACATCACCGGCCTCCTGCTGACCCGCGACGGCGGCACGAACAGCTCCGAGGAGATCTTCA
GGCCAGCGGGAGGCGACATGCGCGACAACTGGCGCTCCGAGCTGTACAAGTACAAGGTGGTGGAGATCCAGCCCCTGG
GCATCGCACCCACCGGGGCCAAGgagCGGGTCGTGGAGCGCGAGAAGgagTAGTAAgggatcc >CH0848d0700.15.05D11gp120, HV1301014

Figure 5 continued

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCG
TGCTGGGGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
ACAACCGCACCGTCTACGACTCGCGGTCCAACGACAACGTGACCTCGATCAACAACACGATCATGGGGGAGATGAAGA
ACTGCTCCTTCAACACGACGACGGAGATCCGCGACAAGGAGAAGAAGGAGTACGCCCTGTTCTACCGCCCCGACATCG
TGCCGCTGAACGAGAACGAGACCAGCAACACCTCGGAGTACAGGCTGATCAACTGCAACACCTCCGCGGTCACGCAGG
CGTGCCCCAAGGTCACGTTCGAGCCCATCCCCATCCACTACTGCGCCCCCGCCGGCTACGCCATCCTGAAGTGCAACA
ACGAGACCTTCAACGGGACCGGCCCGTGCAGCAACGTGTCCACCGTGCAGTGCACGCACGGCATCCGGCCCGTGGTGT
CCACGCAGCTGCTCCTGAACGGGTCGCTGGCGGAGAAGGAGATCGTCATCCGGTCCGAGAACCTCACGAACAACGCGA
AGATCATCATCGTGCACCTGCACACGCCCGTGGAGATCGTGTGCACCCGCCCGGGCAACAACACGCGCAAGTCCGTCC
GGATCGGCCCTGGCCAGACCTTCTACGCCACCGGCGACATCATCGGCGACATCCGCCAGGCCCACTGCAACATCAGCG
AGGAGAAGTGGAACGAGACCCTGCAGAAGGTGGGCATCGAGCTGCAGAAGCACTTCCCCAACAAGACGATTAAGTACG
AGCAGTCGGCCGGCGGCGACATGGAGATCACCACGCACTCCTTCAACTGCGGTGGCGAGTTCTTCTACTGCAACACGT
CGAACCTGTTCAACGGCACGTACAACGGCACCTACATCTCCACGAACTCGTCCGCCAACTCGACGAGCACGATCACGC
TCCAGTGCCGCATCAAGCAGATCATCAACATGTGGCAGGGGGTGGGCCGCGCTATGTACGCACCGCCCATCGCCGGCA
ACATCACCTGCAAGTCCAACATCACCGGCCTCCTGCTGACCCGCGACGGCGGCACGAACAACACCAGCAACGAGGAGA
CGTTCAGGCCAGCGGGAGGCGACATGCGCGACAACTGGCGCTCCGAGCTGTACAAGTACAAGGTGGTGGAGATCCAGC
CCCTGGGCATCGCACCCACCGGGGCCAAGgagCGGGTCGTGGAGCGCGAGAAGgagTAGTAAgggatcc
```

>CH0848d0794.3.03D11gp120, HV1301015

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGG
ACAACCGCACCGTCGGGGAGATGAAGAACTGCTCCTTCAACACGACGACGGAGATCCGCGACAAGGAGAAGAAGGAGT
ACGCCCTGTTCTACCGCCCGGACATCGTGCCGCTGAACAACGAGACGTCGAACACCTCGGAGTACAGGCTGATCAACT
GCAACACCTCCGCGGTCACGCAGGCGTGCCCCAAGGTCACGTTCGAGCCCATCCCCATCCACTACTGCGCCCCCGCCG
GCTACGCCATCCTGAAGTGCAACAACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGAAGGGGATCGTCATCCGGT
CCGAGAACCTCACGAACAACGCGAAGATCATCATCGTGCAGCTGAACACGTCGGTGGAGATCGTGTGCACCCGCCCGA
ACAACAACACGCGCAAGTCCGTCCGGATCGGCCCTGGCCAGACCTTCTACGCCACCGGCGACATCATCGGCGAGATCC
GGCAGGCCCACTGCAACATCAGCGAGGAGAAGTGGAACGAGACCCTGCAGAAGGTGGGCAAGGAGCTGCAGAAGCACT
TCCCCAACAAGACCATTAAGTACGCGCAGTCGGCCGGCGGCGACATGGAGATCACCACGCACTCCTTCAACTGCGGTG
GCGAGTTCTTCTACTGCAACACGGCGAAGCTGTTCAACGGCACGTACAACGGCACCGACATCTCGACGAACTCGTCCA
CCAACTCGAACCCCACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCA
CGAACTCGAGCGGCAAGGAGGAGATCTTCAGGCCAGCGGGAGGCGACATGCGCGACAACTGGCGCTCCGAGCTGTACA
AGTACAAGGTGGTGGAGATCCAGCCCCTGGGCATCGCACCCACCGGGGCCAAGgagCGGGTCGTGGAGCGCGAGAAGg
agTAGTAAgggatcc
```

>CH0848d0836.10.31D11gp120, HV1301016

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
```

Figure 5 continued

```
AGAACTCCACCGTCGAGGAGATGAAGAACTGCTCCTTCAACACGACGACGGAGATCCGCGACAAGGAGAAGAAGGAGT
ACGCCCTGTTCTACCGCCCGGACATCGTGCCGCTGAACAACGAGACGTCGAACACCTCGGAGTACAGGCTGATCAACT
GCAACACCTCCGCGGTCACGCAGGCGTGCCCCAAGGTCACGTTCGAGCCCATCCCCATCCACTACTGCGCCCCCGCCG
GCTACGCCATCCTGAAGTGCAACGACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGAAGGGGATCGTCATCCGGT
CCGAGAACCTCACGAACAACGCGAAGATCATCATCGTGCACCTGCACACGCCCGTGGAGATCGTGTGCACCCGCCCGA
ACAACAACACGCGCAAGTCCGTCCGGATCGGCCCTGGCCAGACCTTCTACGCCACCGGCGACATCATCGGCGACATCC
GGCAGGCCCACTGCAACATCAGCGAGTCCAAGTGGAACGAGACCCTGCAGAAGGTGGGCAAGGAGCTGCAGAAGCACT
TCCCCAACAAGACCATTAAGTACGCGCAGTCGGCCGGCGGCGACATGGAGATCACCACGCACTCCTTCAACTGCGGTG
GCGAGTTCTTCTACTGCAACACGGCGAAGCTGTTCAACGGGACGTACAACGGCACGGACATCTCCACGAACTCCTCGA
CGAACTCGAACCCGACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCA
CGAACTCGAGCGGGAAGGAGGAGATCTTCAGGCCAGCGGGAGGCGACATGCGCGACAACTGGCGCTCCGAGCTGTACA
AGTACAAGGTGGTGGAGATCCAGCCCCTGGGCATCGCACCCACCGGGGCCAAGgagCGGGTCGTGGAGCGCGAGAAGg
agTAGTAAgggatcc
```

>CH0848d0808.15.27D11gp120, HV1301017

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCT
TCCTGGACAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACCGCACCGTCTACGAGATGAAGAACTGCTCCTTCAACACGACGACGGAGATCCGCGACAAGGAGAAGAAGGAGT
ACGCCCTGTTCTACCGCCCGGACATCGTGCCGCTGAACGAGAACGAGACGTCGAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCG
CCGGCTACGCCATCCTGAAGTGCAACAACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCC
GGTCCGAGAACCTCACGAACAACGCGAAGATCATCATCGTGCACCTGAACACGCCCGTGGAGATCGTGTGCACCCGCC
CGAACAACAACACGCGCAAGTCCGTCCGGATCGGCCCTGGCCAGACCTTCTACGCCACCGGCGACATCATCGGCGACA
TCCGGCAGGCCCACTGCAACATCAGCGAGAAGGAGTGGAACGAGACCCTGCAGAAGGTGGGCAAGGAGCTGCAGAAGC
ACTTCCCCAACAAGACCATTAAGTACGAGCAGTCGGCCGGCGGCGACATGGAGATCACCACGCACTCCTTCAACTGCG
GTGGCGAGTTCTTCTACTGCAACACGGCGAAGCTGTTCAACGGCACGTACAACGGCACCGACATCTCGACGAACTCGT
CCGCGAAGTCGAACTCGACGATCACGCTCCAGTGCCGCATCAAGCAGATCATCAACATGTGGCAGGGGGTGGGCCGCG
CTATGTACGCACCGCCCATCGCCGGCAACATCACCTGCAAGTCCAACATCACCGGCCTCCTGCTGACCCGCGACGGCG
GCAACTCGTCGAAGACGGAGGAGGAGACGTTCAGGCCAGCGGGAGGCGACATGCGCGACAACTGGCGCTCCGAGCTGT
ACAAGTACAAGGTGGTGGAGATCCAGCCCCTGGGCATCGCACCCACCGGGGCCAAGgagCGGGTCGTGGAGCGCGAGA
AGgagTAGTAAgggatcc
```

>CH0848d0949.10.18D11gp120, HV1301018

```
gtcgacaagaaGCCACCATGCGCGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCT
TCCTGGACAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGACGGCCACGGTGG
ACAACTCGACGGTGGAGGAGATGAAGAACTGCTCCTTCAACACGACGACGGAGATCCGCGACAAGGAGAAGAAGGAGT
ACGCCCTGTTCTACCGCCCGGACATCGTGCCGCTGAACGAGAACGAGACGTCGAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCG
CCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCC
GGTCCGAGAACCTCACGAACAACGCGAAGATCATCATCGTGCACCTGCACACGCCCGTGGAGATCGTGTGCACCCGCC
CGAACAACAACACGCGCAAGTCCGTCCGGATCGGCCCTGGCCAGACCTTCTACGCCACCGGCGACATCATCGGCGAGA
```

Figure 5 continued

TCCGCCAGGCCCACTGCAACATCAGCGAGGAGGAGTGGAACGAGACCCTGCAGAAGGTGGGCAAGGAGCTGCAGAAGC
ACTTCCCCAACAAGACCATTAAGTACGAGCAGTCGGCCGGCGGCGACATGGAGATCACCACGCACTCCTTCAACTGCG
GTGGCGAGTTCTTCTACTGCAACACGGCCAACCTGTTCAACGGGACGTACAACGGCACCGACATCTCCACGAACTCCT
CGACGAAGTCGAACTCGACGATCACGCTCCAGTGCCGCATCAAGCAGATCATCAACATGTGGCAGGGGGTGGGCCGCG
CTATGTACGCACCGCCCATCGCCGGCAACATCACCTGCAAGTCCAACGTGACCGGCCTCCTGCTGACCCGCGACGGCG
GCACCAACTCGTCGCAGACCGAGGAGGAGACCTTCAGGCCAGCGGGAGGCGACATGCGCGACAACTGGCGCTCCGAGC
TGTACAAGTACAAGGTGGTGGAGATCCAGCCCCTGGGCATCGCACCCACCGGGGCCAAGgagCGGGTCGTGGAGCGCG
AGAAGgagTAGTAAgggatcc >CH0848d0808.15.25D11gp120, HV1301019 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAGCCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACCGCACCGTCGAGGAGATGAAGAACTGCTCCTTCAACACGACGACGGAGATCCGCGACAAGGAGAAGAAGGAGT
ACGCCCTGTTCTACCGCCCGGACATCGTGCCGCTGAACGAGAACGAGACGTCGAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCG
CCGGCTACGCCATCCTGAAGTGCAACGACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGGAGAAGGAGATCGTCATCC
GGTCCGAGAACCTCACGAACAACGCGAAGATCATCATCGTGCACCTGAACGCGCCCGTGGAGATCGTGTGCACCCGCC
CGAACAACGACACGCGCAAGTCCGTCCGGATCGGCCCTGGCCAGACCTTCTACGCCACCGGCGACATCATCGGCGACA
TCCGGCAGGCCCACTGCAACATCAGCGAGAAGGAGTGGAACGAGACCCTGCAGAAGGTGGGCATCGAGCTGCAGAAGC
ACTTCCCCAACAAGACCATTAAGTACGAGCAGTCGGCCGGCGGCGACATGGAGATCACCACGCACTCCTTCAACTGCG
GTGGCGAGTTCTTCTACTGCAACACGTCGAAGCTGTTCAACGGCACGTACAACGGCACCTACATCAACACGTCGTCGA
ACTCGACGATCACGCTCCAGTGCCGCATCAAGCAGATCATCAACATGTGGCAGGGGTGGGCCGCGCTATGTACGCAC
CGCCCATCGCCGGCAACATCACCTGCAAGTCCGACATCACCGGCCTCCTGCTGACCCGCGACGGCGGCACGAACTCGA
GCGGCAAGGAGGAGATCTTCAGGCCAGCGGGAGGCGACATGCGCGACAACTGGCGCTCCGAGCTGTACAAGTACAAGG
TGGTGGAGATCCAGCCCCTGGGCATCGCACCCACCGGGGCCAAGgagCGGGTCGTGGAGCGCGAGAAGgagTAGTAAg
ggatcc >CH0848d0864.3.03D11gp120, HV1301020 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAGCCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACACGGTCAACA
ACCGCACCGTCTACGAGATGAAGAACTGCTCCTTCAACACGACGACGGAGATCCGCGACAAGGAGAAGAAGGAGTACG
CCCTGTTCTACCGCCCGGACATCGTGCCGCTGAACGAGAACGAGACGTCGAACACCTCGGAGTACAGGCTGATCAACT
GCAACACCTCCGCGGTCACGCAGGCGTGCCCCAAGGTCACGTTCGAGCCCATCCCCATCCACTACTGCGCCCCCGCCG
GCTACGCCATCCTGAAGTGCAACGACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGAAGGAGATCGTCATCCGGT
CCGAGAACCTCACGAACAACGCGAAGATCATCATCGTGCAGCTGAACACGTCGGTGGAGATCGTGTGCACCCGCCCGA
ACAACAACACGCGCAAGTCCGTCCGGATCGGCCCTGGCCAGACCTTCTACGCCACCGGCGACATCATCGGCGAGATCC
GGCAGGCCCACTGCAACATCAGCGAGAAGGAGTGGAACGAGACCCTGCAGAAGGTGGGCAAGGAGCTGCAGAAGCACT
TCCCCAACAAGACCATTAAGTACGCGCAGTCGGCCGGCGGCGACATGGAGATCACCACGCACTCCTTCAACTGCGGTG
GCGAGTTCTTCTACTGCAACACGGCCAACCTGTTCAACGGCACGTACAACGGCACCGACATCTCGACGAACTCCTCGA

Figure 5 continued

```
CGAAGTCGAACTCGACGATCACGCTCCAGTGCCGCATCAAGCAGATCATCAACATGTGGCAGGGGGTGGGCCGCGCTA
TGTACGCACCGCCCATCGCCGGCAACATCACCTGCCGCTCCACGATCACCGGCCTCCTGCTGACCCGCGACGGCGGCA
ACTCGTCGAAGACCGAGGAGGAGACGTTCAGGCCAGCGGGAGGCGACATGCGCGACAACTGGCGCTCCGAGCTGTACA
AGTACAAGGTGGTGGAGATCCAGCCCCTGGGCATCGCACCCACCGGGGCCAAGgagCGGGTCGTGGAGCGCGAGAAGg
agTAGTAAgggatcc
```

>CH0848d0893.10.05D11gp120, HV1301021

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGAGAAGGAGGTGCACAACGTGTGGGCGACCCACGCCTGCGTGCCCACGGACCCCAGCCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACACGGTCAACA
ACCGCACCGTCTACGAGATGAAGAACTGCTCCTTCAACACGACGACGGAGATCCGCGACAAGGAGAAGAAGGAGTACG
CCCTGTTCTACCGCCCGGACATCGTGCCGCTGAACGAGAACGAGACGTCGAACACCTCGGAGTACAGGCTGATCAACT
GCAACACCTCCGCGGTCACGCAGGCGTGCCCCAAGGTCACGTTCGAGCCCATCCCCATCCACTACTGCGCCCCCGCCG
GCTACGCCATCCTGAAGTGCAACGACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGAAGGAGATCGTCATCCGGT
CCGAGAACCTCACGAACAACGCGAAGATCATCATCGTGCAGCTGAACACGTCGGTGGAGATCGTGTGCACCCGCCCGA
ACAACAACACGCGCAAGTCCGTCCGGATCGGCCCTGGCCAGACCTTCTACGCCACCGGCGACATCATCGGCGAGATCC
GGCAGGCCCACTGCAACATCAGCGAGGAGGAGTGGAACGACACCCTGCAGAAGGTGGGCAAGGAGCTGCAGAAGCACT
TCCCCAACAAGACCATTGAGTACAAGCAGTCGGCCGGCGGCGACATGGAGATCACCACGCACTCCTTCAACTGCGGTG
GCGAGTTCTTCTACTGCAACACGGCCAAGCTGTTCAACGGGACGTACAACGGCACGGACATCTCCACGAACTCCTCGA
CGAACTCGAACCCGACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCA
ACTCGTCGAAGACGGAGGAGGAGATCTTCAGGCCAGCGGGAGGCGACATGCGCGACAACTGGCGCTCCGAGCTGTACA
AGTACAAGGTGGTGGAGATCCAGCCCCTGGGCATCGCACCCACCGGGGCCAAGgagCGGGTCGTGGAGCGCGAGAAGg
agTAGTAAgggatcc
```

>CH0848d0949.10.10D11gp120, HV1301022

```
gtcgacaagaaGCCACCATGCGCGTGATGGGCATCCTCAAGAACTACCCGCAGTGGTGGATCTGGGGCATCCTGGGCT
TCTGGATGCTCATGAACTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGGACAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGG
AGAACAAGACGGTGGAGGAGATGAAGAACTGCTCCTTCAACACGACGACGGAGATCCGCGACAAGGAGAAGAAGGAGT
ACGCCCTGTTCTACAAGCCGGACGTCGTGCCGCTGGACGAGACGAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACGACGAGACCTTCAACGGGACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGCACACGCCCGTGGAGATCGTGTGCACCCGCCCGAACA
ACAACACGCGCAAGTCCGTCCGGATCGGCCCTGGCCAGACCTTCTACGCCACCGGCGACATCATCGGCGACATCAAGC
AGGCCCACTGCAACATCAGCGAGAAGAAGTGGAACGACACCCTGCAGAAGGTGGGCATCGAGCTGCAGAAGCACTTCC
CCAACAAGACCATTAAGTACAACCAGTCGGCCGGCGGCGACATGGAGATCACCACGCACTCCTTCAACTGCGGTGGCG
AGTTCTTCTACTGCAACACGTCGAACCTGTTCAACGGGACGTACAACGGCACCTACATCTCCACGAACTCCTCGGCGA
ACTCGACCTCGACGATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCACCA
ACTCGAACGACGGAGACCTTCAGGCCAGCGGGAGGCGACATGCGCGACAACTGGCGCTCCGAGCTGTACAAGTACA
AGGTGGTGGAGATCCAGCCCCTGGGCATCGCACCCACCGGGGCCAAGgagCGGGTCGTGGAGCGCGAGAAGgagTAGT
AAgggatcc
```

Figure 5 continued

>CH0848d0949.10.17D11gp120, HV1301023 gtcgacaagaaGCCACCATGCGCGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACGGGACGGTGGAGGAGATGAAGAACTGCTCCTTCAACACGACGACGGAGATCCGCGACAAGGAGAAGAAGGAGT
ACGCCCTGTTCTACAAGCCGGACATCGTGCCGCTGTCGGAGACGAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACGACGAGACCTTCAACGGGACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGCACACGCCCGTGGAGATCGTGTGCACCCGCCCGAACA
ACAACACGCGCAAGTCCGTCCGGATCGGCCCTGGCCAGACCTTCTACGCCACCGGCGACATCATCGGCGACATCAAGC
AGGCCCACTGCAACATCAGCGAGGAGAAGTGGAACGACACCCTGCAGAAGGTGGGCATCGAGCTGCAGAAGCACTTCC
CCAACAAGACCATTAAGTACAACCAGTCGGCCGGCGGCGACATGGAGATCACCACGCACTCCTTCAACTGCGGTGGCG
AGTTCTTCTACTGCAACACGTCGAACCTGTTCAACGGGACGTACAACGGCACCTACATCTCCACGAACTCCTCGGCGA
ACTCGACCTCGACGATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCACCA
ACTCGAACGAGACGGAGACCTTCAGGCCAGCGGGAGGCGACATGCGCGACAACTGGCGCTCCGAGCTGTACAAGTACA
AGGTGGTGGAGATCCAGCCCCTGGGCATCGCACCCACCGGGGCCAAGgagCGGGTCGTGGAGCGCGAGAAGgagTAGT
AAgggatcc >CH0848d0808.15.15D11gp120, HV1301024 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACCGCACCGTCGAGGAGATGAAGAACTGCTCCTTCAACACGACGACGGAGATCCGCGACAAGGAGAAGAAGGAGT
ACGCCCTGTTCTACAAGCCGGACGTGGTGCCGCTGGACGAGACGAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACAACGAGACCTTCAACGGGACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGAACACGCCCGTGGAGATCGTGTGCACCCGCCCGAACA
ACAACACGCGCAAGTCCGTCCGGATCGGCCCTGGCCAGACCTTCTACGCCACCGGCGACATCATCGGCGACATCCGGC
AGGCCCACTGCAACATCAGCGAGGAGCAGTGGAACGACACCCTGCAGAAGGTGGGCAAGGAGCTGAAGAAGCACTTCC
CCAACAAGACCATTAAGTACGCGCAGTCGGCCGGCGGCGACATGGAGATCACCACGCACTCCTTCAACTGCGGTGGCG
AGTTCTTCTACTGCAACACGGCGAAGCTGTTCAACGGCACGTACAACGGCACCGACATCTCGACGAACTCGTCCGCGG
ACTCGAACTCGACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCCACATCACCGGCCTCCTGCTGACCCGCGACGGCGGCACGA
ACTCGAGCGGCAAGGAGGAGATCTTCAGGCCAGCGGGAGGCGACATGCGCGACAACTGGCGCTCCGAGCTGTACAAGT
ACAAGGTGGTGGAGATCCAGCCCCTGGGCATCGCACCCACCGGGGCCAAGgagCGGGTCGTGGAGCGCGAGAAGgagT
AGTAAgggatcc >CH0848d0780.15.22D11gp120, HV1301025 gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCC
GCGCCTACGAGAAGGAGGTGCACAACGTGTGGGCGACCCACGCCTGCGTGCCCACGGACCCCAACCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA

Figure 5 continued

```
AGAACCGCACCGTCGAGGAGATGAAGAACTGCTCCTTCAACACGACGACGGAGATCCGCGACAAGGAGAAGAAGGAGT
ACGCCCTGTTCTACAAGCCGGACGTGGTGCCGCTGGACGAGACGAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACAACGAGACCTTCAACGGGACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGAACACGCCCGTGGAGATCGTGTGCACCCGCCCGAACA
ACAACACGCGCAAGTCCGTCCGGATCGGCCCTGGCCAGACCTTCTACGCCACCGGCGACATCATCGGCGACATCCGGC
AGGCCCACTGCAACATCAGCGAGAAGCAGTGGAACGACACCCTGCAGAAGGTGGGCAAGGAGCTGAAGAAGCACTTCC
CCAACAAGACCATAAAGTACGCGCAGTCGGCCGGCGGCGACATGGAGATCACCACGCACTCCTTCAACTGCGGTGGCG
AGTTCTTCTACTGCAACACGGCGAAGCTGTTCAACGGCACGTACAACGGCACCGACATCTCGACGAACTCGTCCGCCG
ACTCGAACAGCACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCCACATCACCGGCCTCCTGCTGACCCGCGACGGCGGCACGA
ACTCGAGCGAGAAGGAGGAGATCTTCAGGCCAGCGGGAGGCGACATGCGCGACAACTGGCGCTCCGAGCTGTACAAGT
ACAAGGTGGTGGAGATCCAGCCCCTGGGCATCGCACCCACCGGGGCCAAGgagCGGGTCGTGGAGCGCGAGAAGgagT
AGTAAgggatcc
```

>CH0848d0780.15.29D11gp120, HV1301026

```
gtcgacaagaaGCCACCATGCGGGTGATGGGCATCCCCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAACCCGCAGGAGCTCG
TGCTGGGCAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACCGCACCGTCGAGGAGATGAAGAACTGCTCCTTCAACACGACGACGGAGATCCGCGACAAGGAGAAGAAGGAGT
ACGCCCTGTTCTACAAGCCGGACGTGGTGCCGCTGGACGAGACGAACAACACCTCGGAGTACAGGCTGATCAACTGCA
ACACCTCCGCGGTCACGCAGGCGTGCCCCAAGGTCACGTTCGAGCCCATCCCCATCCACTACTGCGCCCCCGCCGGCT
ACGCCATCCTGAAGTGCAACAACGAGACCTTCAACGGGACCGGCCCGTGCAGCAACGTGTCCACCGTGCAGTGCACGC
ACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGAACACGCCCGTGGAGATCGTGTGCACCCGCCCGAACA
ACAACACGCGCAAGTCCGTCCGGATCGGCCCTGGCCAGACCTTCTACGCCACCGGCGACATCATCGGCGACATCCGGC
AGGCCCACTGCAACATCAGCGAGAAGCAGTGGAACGACACCCTGCAGAAGGTGGGCAAGGAGCTGAAGAAGCACTTCC
CCAACAAGACCATTAAGTACGCGCAGTCGGCCGGCGGCGACATGGAGATCACCACGCACTCCTTCAACTGCGGTGGCG
AGTTCTTCTACTGCAACACGGCGAAGCTGTTCAACGGCACGTACAACGGCACCGACATCTCGACGAACTCGTCCGCCG
ACTCGAACAGCACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCCACATCACCGGCCTCCTGCTGACCCGCGACGGCGGCACGA
ACTCGAGCGAGAAGGAGGAGATCTTCAGGCCAGCGGGAGGCGACATGCGCGACAACTGGCGCTCCGAGCTGTACAAGT
ACAAGGTGGTGGAGATCCAGCCCCTGGGCATCGCACCCACCGGGGCCAAGgagCGGGTCGTGGAGCGCGAGAAGgagT
AGTAAgggatcc
```

>CH0848d0808.15.43D11gp120, HV1301027

```
gtcgacaagaaGCCACCATGCGGGTGATGGGCATCCTCAAGAACTACCCGCAGTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACCTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
AGAACCGCACCGTCGAGGAGATGAAGAACTGCTCCTTCAACACGACGACGGAGATCCGCGACAAGGAGAAGAAGGAGT
ACGCCCTGTTCTACCGCCCGGACATCGTGCCGCTGAACGAGAACGAGACGTCGAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCG
CCGGCTACGCCATCCTGAAGTGCAACAACGAGACCTTCAACGGGACCGGCCCGTGCAGCAACGTGTCCACCGTGCAGT
GCACGCACGGCATCCGGCCCGTGGTGTCCACGCAGCTGCTCCTGAACGGGTCGCTGGCGGAGAAGGAGATCGTCATCC
GGTCCGAGAACCTCACGAACAACGCGAAGATCATCATCGTGCACCTGCACACGCCCGTGGAGATCGTGTGCACCCGCC
CGAACAACAACACGCGCAAGTCCGTCCGGATCGGCCCTGGCCAGACCTTCTACGCCACCGGCGACATCATCGGCGACA
```

Figure 5 continued

```
TCCGGCAGGCCCACTGCAACATCAGCGAGAAGCAGTGGAACGACACCCTGCAGAAGGTGGGCAAGGAGCTGCAGAAGC
ACTTCCCCAACAAGACCATTAAGTACAAGCACTCGGCCGGCGGCGACATGGAGATCACCACGCACTCCTTCAACTGCG
GTGGCGAGTTCTTCTACTGCAACACGTCGAACCTGTTCAACGGCACGTACAACGGCACCTACATGAACATCTCGACGG
ACTCGAACTCGACGATCACGCTCCAGTGCCGCATCAAGCAGATCATCAACATGTGGCAGGGGGTGGGCCGCGCTATGT
ACGCACCGCCCATCGCCGGCAACATCACCTGCAAGTCCCACATCACCGGCCTCCTGCTGACCCGCGACGGCGGCACGA
ACTCGAGCGGCAAGGAGGAGATCTTCAGGCCAGCGGGAGGCGACATGCGCGACAACTGGCGCTCCGAGCTGTACAAGT
ACAAGGTGGTGGAGATCCAGCCCCTGGGCATCGCACCCACCGGGGCCAAGgagCGGGTCGTGGAGCGCGAGAAGgagT
AGTAAgggatcc
```

\>CH0848d1120.10.05D11gp120, HV1301028

```
gtcgacaagaaGCCACCATGCGCGTGATGGGCATCCCCAAGAACTACCCGCAGTGGTGGATCTGGGGCATCCTGGGCT
TCTGGATGCTCATGAACTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGACGGCCACGGTGA
ACAAGTCCACGGTGGAGGAGATGAAGAACTGCTCCTTCAACACGACGACGGAGATCCGCGACAAGGAGAAGAAGGAGT
ACGCCCTGTTCTACCGCCCGGACATCGTGCCGCTGAACAACAAGACGTCGAACACCTCGGAGTACAGGCTGATCAACT
GCAACACCTCCGCGGTCACGCAGGCGTGCCCCAAGGTCACGTTCGAGCCCATCCCCATCCACTACTGCGCCCCCGCCG
GCTACGCCATCCTGAAGTGCAACGACGAGACCTTCAACGGGACCGGCCCGTGCAGCAACGTGTCCACCGTGCAGTGCA
CGCACGGCATCCGGCCCGTGGTGTCCACGCAGCTGCTCCTGAACGGGTCGCTGGCGGAGGAGGAGATCGTCATCCGGT
CCGAGAACCTCACGAACAACGCGAAGATCATCATCGTGCACCTGCACACGCCCGTGGAGATCGTGTGCACCCGCCCGA
ACAACAACACGCGCAAGTCCGTCCGGATCGGCCCTGGCCAGACCTTCTACGCCACCGGCGGCATCATCGGCGACGTGC
GCCAGGCCCACTGCAACATCAGCAAGGGCCTCTGGAACGACACCCTGCAGAAGGTGGGCAAGGAGCTGCAGAAGCACT
TCCCCAACAAGACCATTCGCTACAACCAGTCGGCCGGCGGCGACATGGAGATCACCACGCACTCCTTCAACTGCGGTG
GCGAGTTCTTCTACTGCAACACGGCCAAGCTGTTCAACGGGACGTACAACGGCACCGACATCTCCACGAACTCCTCGG
CGAACAACTCGTCCACGATCACGCTCCAGTGCCGCATCAAGCAGATCATCAACATGTGGCAGGGGGTGGGCCGCGCTA
TGTACGCACCGCCCATCGCCGGCAACATCACCTGCAAGTCCAACATCACCGGCCTCCTGCTGACCCGCGACGGCGGCA
TCAACTCGTCGCGCGAGGAGGAGATCTTCAGGCCAGCGGGAGGCGACATGCGCGACAACTGGCGCTCCGAGCTGTACA
AGTACAAGGTGGTGGAGGTGCAGCCCCTGGGCATCGCACCCACCGGGGCCAAGgagCGGGTCGTGGAGCGCGAGAAGg
agTAGTAAgggatcc
```

\>CH0848d1432.5.06D11gp120, HV1301029

```
gtcgacaagaaGCCACCATGCGCGTGATGGGCATCCCCAAGAACTACCCGCGCTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGTGAAGGAGGTGCACAACGTGTGGGCGACCCACGCCTGCGTGCCCACGGACCCCAGCCCGCAGGAGCTCC
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGG
AGAACTCGACGACGGACGAGATGAAGAACTGCTCCTTCAACACGACGACGGAGATCCGCGACAAGGAGAAGAAGGAGC
GCGCCCTGTTCTACCGCCCGGACATCGTGCCGCTGAACAACGAGACGGGCAACACCTCGGAGTACAGGCTGATCAACT
GCAACACCTCCGCGATCACGCAGGCGTGCCCCAAGGTCACGTTCGAGCCCATCCCCATCCACTACTGCGCCCCCGCCG
GCTACGCCATCCTGAAGTGCAACGACGAGACCTTCAACGGGACCGGCCCGTGCAGCTCGGTGTCCACCGTGCAGTGCA
CGCACGGCATCCGGCCCGTGGTGTCCACGCAGCTGCTCCTGAACGGGTCGCTGGCGGAGAAGGGGATCGTCATCCGGT
CCGAGAACCTCACGAACAACGCGAAGATCATCATCGTGCACCTGAACGCCTCCGTGGAGATCGTGTGCACCCGCCCGA
ACAACAACACGCGCAAGTCCGTCCGGATCGGCCCTGGCCAGACCTTCTACGCCACCGGCGACATCATCGGCGACATCC
GCCAGGCCCACTGCAACATCAGCGAGAAGAAGTGGAACGAGACCCTGCAGAAGGTGGGCATCGAGCTGCAGAAGCACT
TCCCCAACAAGACCATTAAGTACAACCAGTCGGCCGGCGGCGACATGGAGATCACCACGCACTCCTTCAACTGCGGTG
GCGAGTTCTTCTACTGCAACACGGCCAAGCTGTTCAACTCGACGTACAACGGCACCTACATCTCCACGAACTCCATCA
ACTCGACCCTGAACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCATCC
ACAACGACTCGAACGAGACGGAGACCTTCAGGCCAGCGGGAGGCGACATGCGCGACAACTGGCGCTCCGAGCTGTACA
```

Figure 5 continued

AGTACAAGGTGGTGGAGGTGCAGCCCCTGGGCATCGCACCCACCGGGGCCAAGgagCGGGTCGTGGAGCGCGAGAAGg
agTAGTAAgggatcc >CH0848d1432.5.48D11gp120, HV1301030 gtcgacaagaaGCCACCATGCGCGTGATGGGCATCCCCAAGAACTACCCGCGCTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGTGAAGGAGGTGCACAACGTGTGGGCGACCCACGCCTGCGTGCCCACGGACCCCAGCCCGCAGGAGCTCC
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGG
AGAACTCGACGACGGACGAGATGAAGAACTGCTCCTTCAACACGACGACGGAGATCCGCGACAAGGAGAAGAAGGAGC
GCGCCCTGTTCTACCGCCCGGACATCGTGCCGCTGAACAACGAGACGGGCAACACCTCGGAGTACAGGCTGATCAACT
GCAACACCTCCGCGGATCACGCAGGCGTGCCCCAAGGTCACGTTCGAGCCCATCCCCATCCACTACTGCGCCCCGCCG
GCTACGCCATCCTGAAGTGCAACGACGAGACCTTCAACGGGACCGGCCCGTGCAGCTCGGTGTCCACCGTGCAGTGCA
CGCACGGCATCCGGCCCGTGGTGTCCACGCAGCTGCTCCTGAACGGGTCGCTGGCGGAGAAGGGGATCGTCATCCGGT
CCGAGAACCTCACGAACAACGCGAAGATCATCATCGTGCACCTGAACGCCTCCGTGGAGATCGTGTGCACCCGCCCGA
ACAACAACACGCGCAAGTCCGTCCGGATCGGCCCTGGCCAGACCTTCTACGCCACCGGCGACATCATCGGCGACATCC
GCCAGGCCCACTGCAACATCAGCGAGAAGAAGTGGAACGAGACCCTGCAGAAGGTGGGCATCGAGCTGCAGAAGCACT
TCCCCAACAAGACCATTAAGTACAACCAGTCGGCCGGCGGCGACATGGAGATCACCACGCACTCCTTCAACTGCGGTG
GCGAGTTCTTCTACTGCAACACGGCCAAGCTGTTCAACTCGACGTACAACGGCACCTACATCTCCACGAACTCCATCA
ACTCGACCCTGAACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCATCC
ACAACGACTCGAACGAGACGGAGACCTTCAGGCCAGCGGGAGGCGACATGCGCGACAACTGGCGCTCCGAGCTGTACA
AGTACAAGGTGGTGGAGATCCAGCCCCTGGGCATCGCACCCACCGGGGCCAAGgagCGGGTCGTGGAGCGCGAGAAGg
agTAGTAAgggatcc >CH0848d1432.5.35D11gp120, HV1301031 gtcgacaagaaGCCACCATGCGCGTGATGGGCATCCCCAAGAACTACCCGCGCTGGTGGATCTGGGGCATCCTGGGCT
TCTGGATGCTCATGATCTGCAACggcgtgCCGGTGTGGAAGGAGGCCAAGACGACCCTGTTCTGCGCGTCGGACGCCA
AGGCCTACGTGAAGGAGGTGCACAACATCTGGGCGACCCACGCCTGCGTGCCCACGGACCCCAGCCCGCAGGAGCTCC
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCACGGTGA
ACCAGTCCACGACGGAGGAGATGAAGAACTGCTCCTTCAACACGACGACGGAGATCCGCGACAAGGAGAAGAAGGAGC
ACGCCCTGTTCTACCGCCCGGACATCGTGCCGCTGGACAACGAGACGGGCAACACCTCGGAGTACAGGCTGATCAACT
GCAACACCTCCGCGGTCACGCAGGCGTGCCCCAAGGTCACGTTCGAGCCCATCCCCATCCACTACTGCGCCCCGCCG
GCTACGCCATCCTGAAGTGCAACGACGAGACCTTCAACGGGACCGGCCCGTGCAGCAAGGTGTCCACCGTGCAGTGCA
CGCACGGCATCCGGCCCGTGGTGTCCACGCAGCTGCTCCTGAACGGGTCGCTGGCGGAGAAGGGGATCGTCGTGCGGT
CCGAGAACCTCACGAACAACGCGAAGATCATCATCGTGCAGCTGAACGCCTCCGTGGAGATCGTGTGCACCCGCCCGA
ACAACAACACGCGCAAGTCCGTCCGGATCGGCCCTGGCCAGACCTTCTACGCCACCGGCGACATCATCGGCAACATCC
GCCAGGCCCACTGCAACATCAGCGAGAAGAAGTGGAACGAGACCCTGCAGAAGGTGGGCATCGAGCTGCAGAAGCACT
TCCCCAACAAGACCATTAAGTACAACCAGTCGGCCGGCGGCGACATGGAGATCACCACGCACTCCTTCAACTGCGGTG
GCGAGTTCTTCTACTGCAACACGGCCAAGCTGTTCAACTCGACGTACAACGGCACCTACATCTCCACGAACTCCATCA
ACTCGACCCTGAACATCACGCTCCAGTGCCGCATCAAGCAGATCATCAACATGTGGCAGGGGGTGGGCCGCGCTATGT
ACGCACCGCCCATCGCCGGCAACATCACCTGCCGGTCCAACATCACCGGCCTCCTGCTGACCCGCGACGGCGGCATCC
ACAACGACTCGAACGAGACGGAGACCTTCAGGCCAGCGGGAGGCGACATGCGCGACAACTGGCGCTCCGAGCTGTACA
AGTACAAGGTGGTGGAGGTGCAGCCCCTGGGCATCGCACCCACCGGGGCCAAGgagCGGGTCGTGGAGCGCGAGAAGg
agTAGTAAgggatcc >CH0848d1651.10.07D11gp120, HV1301032

Figure 5 continued

```
gtcgacaagaaGCCACCATGCGCGTGATGGGCATCCCGAAGAACTACCCGCTCTGGTGGATCTGGGGCATCCTGGGCT
TCTGGATGCTCATGAACTGCAACggcgtgCCGGTGTGGAAGGAGGCCAAGACGACCCTGTTCTGCGCGTCGGACGCCA
AGGCCTACGTGAAGGAGGTGCACAACGTGTGGGCGACCCACGCCTGCGTGCCCACGGACCCCTCGCCGCAGGAGCTGG
TCCTGGACAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGAACTGCTCGAACGCCATCGTCA
AGAACTCCACGACCGAGGAGATCTCCCACGCCCTCGCGCGGAACTCGACCACCGAGGAGATGAAGAACTGCTCCTTCA
ACACCACGACGGAGATCCGCGACAAGGAGAAGAAGGAGTACGCCCTGTTCTACCGCCCCGACATCGTGCCGCTGAACA
ACAAGACGTCCAACATCTCCGAGTACAGGCTGATCAACTGCAACACCTCCACCGTCACGCAGGCGTGCCCCAAGGTCA
CGTTCGAGCCCATCCCCATCCACTACTGCGCCCCCGCCGGCTACGCCATCCTGAAGTGCAACGACGAGACCTTCAACG
GGACCGGCCCGTGCAGCAACGTGTCCACCGTGCAGTGCACGCACGGCATCCGGCCCGTGGTGTCCACGCAGCTGCTCC
TGAACGGGTCGCTGGCGGAGAAGGGCATCGTCATCCGGTCCGAGAACCTCACGAACAACGCGAAGATCATCATCGTGC
AGCTGAACGCCAACGCCTCGGTGGAGATCGTGTGCACCCGCCCGAACAACAACACGCGCAAGTCCGTGCGGATCGGCC
CTGGCCAGACCTTCTACGCCACCGGCGACATCATCGGCAACATCCGGCAGGCCCACTGCAACATCTCGGAGAAGAAGT
GGAACGAGACCCTGCAGAAGGTGGGCATCGAGCTGCAGAAGCACTTCCCCAACAAGACCATCAAGTACAACCAGTCCG
CCGGCGGCGACATGGAGATCACCACGCACTCCTTCAACTGCGGTGGCGAGTTCTTCTACTGCAACACGGCCAAGCTGT
TCAACTCCACGTACAACGGCACCTACATCTCCACGAACTCGATCAACTCGACGCTGAACATCACGCTCCAGTGCCGGA
TCAAGCAGATCATCAACATGTGGCAGGGGGTGGGCCGCGCTATGTACGCACCGCCCATCGCCGGCAACATCACCTGCC
GGTCCAACATCACCGGCCTCCTGCTGACCCGCGACGGCGGCATCCACAACGACTCCAACGTGACGGAGACCTTCAGGC
CAGCGGGAGGCGACATGCGGGACAACTGGCGCTCCGAGCTGTACAAGTACAAGGTGGTGGAGATCCAGCCCCTGGGCA
TCGCACCCACCGGGGCCAAGgagCGGGTCGTGGAGCGCGGGAAGgagTAGTAAgggatcc >CH0848d1432.5.26D11gp120, HV1301058,
gtcgacaagaaGCCACCATGCGCGTGATGGGCATCCTCAAGAACTACCCGCAGTGGTGGATCTGGGGCATCCTGGGCT
TCTGGATGCTCATGAACTGCAACggcgtgCCGGTGTGGAAGGAGGCCAAGACGACCCTGTTCTGCGCGTCGGACGCCA
AGGCCTACAAGAAGGAGGTGCACAACGTGTGGGCGACCCACGCCTGCGTGCCCACGGACCCCAGCCCGCAGGAGCTCT
TCCTGAAGAACGTGACCGAGAACTTCAACATGTGGAAGAACGACATGGTGGACCAGATGCACGAGGACATCATCTCCC
TGTGGGACCAGTCCCTGAAGCCCTGCGTGAAGCTGACCCCGCTGTGCGTGACCCTGATCTGCTCGAACGCCATCGTGA
AGAACTCGACGACCGAGGAGATGTCCAACGCCACGGTGAAGAACTCGACGACGGAGGAGATGAAGAACTGCTCCTTCA
ACACGACGACGGAGATCCGCGACAAGGAGAAGAAGGAGTACGCCCTGTTCTACCGCCCGGACGTGGTCCCGCTGGACG
AGACGAACAACACCTCGAAGTACAGGCTGATCAACTGCAACACCTCCGCGGTGACGCAGGCGTGCCCCAAGGTCACGT
TCGAGCCCATCCCCATCCACTACTGCGCCCCCGCCGGCTACGCCATCCTGAAGTGCAACGACGAGACCTTCAACGGGA
CCGGCCCGTGCAGCAACGTGTCCACCGTGCAGTGCACGCACGGCATCCGGCCCGTGGTGTCCACGCAGCTGCTCCTGA
ACGGGTCGCTGGCGGAGAAGGAGATCGTCATCCGGTCCGAGAACCTCACGAACAACGCGAAGACGATCATCGTGCACC
TGCACCCCGGTGGAGATCGTGTGCACCCGCCCGTACAACAACACGCGCAAGTCCGTCCGGATCGGCCCTGGCCAGA
CCTTCTACGCCACCGGCGACATCATCGGCGACCCGCGCCAGGCCCACTGCAACATCAGCAAGGAGACCTGGAACAAGA
CCCTGCAGGAGGTGGGCAAGGAGCTGCAGAAGCACTTCCCCAACAAGACCATTCGCTACAACCAGTCGGCCGGCGGCG
ACATGGAGATCACCACGCACTCCTTCAACTGCGGTGGCGAGTTCTTCTACTGCAACACGTCCAACCTGTTCAACTCGA
CGTACAACGACACCTACATCTCCCCGAACTCCACCAACTCGACCTCGACGATCACGCTCCAGTGCCGCATCAAGCAGA
TCATCAACATGTGGCAGGGGGTGGGCCGCGCTATGTACGCACCGCCCATCGCCGGCAACATCACCTGCAAGTCCAACA
TCACCGGCCTCCTGCTGACCCGCGACGGCGGCACGAACAACAACTCGAACGAGACGGAGACCTTCAGGCCAGCGGGAG
GCGACATGCGCGACAACTGGCGCTCCGAGCTGTACAAGTACAAGGTGGTGGAGGTCCAGCCCCTGGGCCTCGCACCCA
CCGGGGCCAAGgagCGGGTCGTGGAGCGCGGAGAAGgagTAGTAAgggatcc
```

Figure 6 Amino acid sequence of CH848 D11gp120 constructs:

>HV1300892_CH848.3.d0078.30.02D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYKPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEKQWNKTLQEVGKELQKHFPNKTIKYERSAGGDMEIATHSFNCGGEFFYCNTSNL
FNGTYNGTYISTHSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GIX

>HV1300893_CH848.3.d0078.30.42D11gp120

MRVMGILKNYPQWWIWGILGFWMLMICNGVPVWKEAKTTLFCASNAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GDRIRDPDX

>HV1300894_CH848.3.d0107.30.12D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISANSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GHRIRDPDXX

>HV1300895_CH848.3.d0107.30.27D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEKQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GNRIRDPDXX

>HV1300896_CH848.3.d0107.30.31D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWSKTLQEVGKELQKHFPNKTIKYERSAGGDMEIATHSFNCGGEFFYCNTSNL
FNGTYNGTYISANSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GYRIRDPDX

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEPQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GDRIRVPDX

>HV1300898_CH848.3.d0135.27.06D11gp120

MRVMGILKNYPQWWIWGILGFWMLMICNGVPVWKEAKTTLFCASDAKAYEKEVHNVWATHACVPTDPSPQELGLENV
TENFNMWKNDMVDQMHEDIISLWDQSLKPCVKLTPLCVTLKCSNAIVDSSKVYDTRSKVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKGIVIRSENLTNNAKIIIVQLNTSVEIVCTRPGNNTRKSVRIGP
GQTFYATGDIIGDIRQAHCNISEWQWNKTLHEVGKELQKHFPNKTIKYERSAGGDMEIATHSFNCGGEFFYCNTSNL
FNGTYNGTYINTSSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GDRIQDPDX

>HV1300899_CH848.3.d0135.60.05D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISESQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GDRIQVPDX

>HV1300900_CH848.3.d0135.60.14D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEWQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGHITCKSNITGLLLTRDGGTKNNSNETEETFRP
AGGDMRDNWRSELYKYKVVEIQPLGIAPTGAKERVVEREKE**GDRIRDLDX

>HV1300901_CH848.3.d0135.60.19D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYKPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISESQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTPDGGTKNNSNETEETFRP
AGGDMRDNWRSELYKYKVVEIQPLGIAPTGAKERVVEREKE**GDRIRVLDX

>HV1300902_CH848.3.d0135.60.20D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEKQWNKTLQEVGKELQKHFPNKTIKYERSAGGDMEIATHSFNCGGEFFYCNTSNL
FNGTYNGTYISTNSNSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GHRIRVPDXX

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEGGQWNKTLQEVGKELQKHFPNKTIKYERSAGGDMEIATHSFNCGGEFFYCNTSNL
FNGTYNGTYISTNSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GHRIQDPDX

>HV1300904_CH848.3.d0135.60.34D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISTNSNSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GHRIQVPDX

>HV1300905_CH848.3.d0194.25.17D11gp120

MRVMGILKNYPQWWIWGILGFWMLMICNGVPVWKEAKTTLFCASDAKAYEKEVHNVWATHACVPTDPSPQELVLENV
IENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRSDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISTNSSTNSTSNITLQCRIKQIINMWQGVGRAMYAPPIAGNITCKSNITGLLLTRDGGTKNNSNETEE
TFRPAGGDMRDNWRSELYKYKVVEIQPLGIAPTGAKERVVEREKE**GHRIRDLDX

>HV1300906_CH848.3.d0194.25.21D11gp120

MKVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEKQWNKTLQEVGKELQKHFPNKTIKYERSAGGDMEIATHSFNCGGEFFYCNTSNL
FNGTYNGTYISTNSTSSITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GHRIRVLDX

>HV1300907_CH848.3.d0194.25.24D11gp120

MRVMGILKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNATVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISESQWNKTLQEVGKELQKHFPNKTIKYERSAGGDMEIATHSFNCGGEFFYCNTSNL
FNGTYNGTYINTSSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GNRIRVPDXX

>HV1300908_CH848.3.d0194.25.48D11gp120

MRVMGIPKNYPQWWIWGILGFWMLMICNGVPVWKEAKTTLFCASDAKAYEKEVHNVWATHACVPTDPSPQELVLENV
TENFNMWKNDMVDQMHEDIISLWDQSLKPCVKLTPLCVTLNCSNAIVDSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEWQWNKTLQEVGKELQKHFPNKTIKYERSAGGDMEIATHSFNCGGEFFYCNTSNL

Figure 6 continued

FNGTYNGTYINTSSTSNITLQCRIKQIINMWQGVGRAMYAPPIAGNITCKSNITGLLLTRDGGTKNNSNETEETFRP
AGGDMRDNWRSELYKYKVVEIQPLGIAPTGARERVVEREKE**GNRIQDPDX

>HV1300909_CH848.3.d0274.30.02D11gp120

MRVMGILKNYPQWWIWGILGFWMLMICNGVPVWKEAKTTLFCASDAKAYEKEVHNVWATHACVPTDPSPQELVLKNV
TENFNMWKNDMVDQMHEDIISLWDQSLKPCVKLTPLCVTLNCSNATVNSSKVYDTRSNVNVTSINNTIMGEMKNCSF
NTTTEIRDKEKKEYALFYRPDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEWQWNKTLHEVGKELQKHFPNKTIKYERSAGGDMEIATHSFNCGGEFFYCNTSNL
FNGTYNGTYINTSSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GNRIQVPDX

>HV1300910_CH848.3.d0274.30.07D11gp120

MRVMGIPKNYPQWWIWGILGFWILMICNGVPVWKEAKTTLFCASDAKAYEKEVHNVWATHACVPTDPSPQELVLKNV
TENFNMWKNDMVDQMHEDIISLWDQSLKPCVKLTPLCVTLNCNSATVDNSKVYDTRSNVNVTSINNTIMGEMKNCSF
NTTTEIRDKEKKEYALFYKPDVVPLDETSNTSEYRLINCNTSAVTQACPKVTFEPIPIHYCAPAGYAILKCNDKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEGQWNKTLHEVSKELQKHFPNKTIKYERSAGGDMEIATHSFNCGGEFFYCNTSNL
FNGTYNGTYINTSSTSNITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GNRIRDLDX

>HV1300911_CH848.3.d0274.30.09D11gp120

MRVRGILKNYPQWWIWGILGFWMLMICNGVPVWKEAKTTLFCASDAKAYEKEVHNVWATHACVPTDPSPQELVLENV
IENFNMWKNDMVDQMHEDIISLWDQSLKPCVKLTPLCVTLNCSNATVNSSKVYDTRSNVNVTSINNTIMGEMKNCSF
NTTTEIRDKEKKEYALFYRSDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTPVEIVCTRPGNNTRKSVRIGP
GQTFYATGDIIGDIRQAHCNISERQWNKTLQEVGKELQKHFPNKTIKYERSAGGDMEIATHSFNCGGEFFYCNTSNL
FNGTYNGTYISTNSSTNSTSNITLQCRIKQIINMWQGVGRAMYAPPIAGNITCKSNITGLLLTRDGGTKNNSNETEE
TFRPAGGDMRDNWRSELYKYKVVEIQPLGIAPTGAKERVVEREKE**GNRIRVLDX

>HV1300912_CH848.3.d0274.30.14D11gp120

MRVMGILKNYLQWWIWGILGFWMLMICKGVPVWKEAKTTLFCASDAKAYEKEVHNVWATHACVPTDPSPQELVLENV
IENFNMWKNDMVDQMHEDIISLWDQSLKPCVKLTPLCVTLTCSNATVDNSKVYDTRSNVNVTSINNTIMGEMKNCSF
NTTTEIRDKEKKEYALFYRSDVVPLDETSNTSEYRLINCNTSAVTQACPKVTFEPIPIHYCAPAGYAILKCNNKTFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISERQWYKTLQEVGKELQKHFPNKTIKYERSAGGDMEIATHSFNCGGEFFYCNTSNL
FNGTYNGTYISINSTSYITLQCRIKQIINMWQGVGRAMYAPPIAGNITCKSNITGLLLTRDGGTKNNSNETEETFRP
AGGDMRDNWRSELYKYKVVEIQPLGIAPTGAKERVVEREKE**GYRIPVPDXX

>HV1300913_CH848.3.d0358.80.03D11gp120

MKVMGILKNYPQWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLNCSNARSNVNVTSINNTIMGEMKNCSFNTTTEIRDKE
KKEYALFYKPDVVPLNETSNTSEYRLINCNTSAVTQACPKVTFEPIPIHYCAPAGYAILKCNNETFNGTGPCSNVST
VQCTHGIRPVVSTQLLLNGSLAEKEIVIRSENLTNNAKIIIVHLNTPVEIVCTRPGNNTRKSVRIGPGQTFYATGDI
IGDIRQAHCNISEGQWNKTLQEVGKELQKHFPNKTIKYERSAGGDMEITTHSFNCGGEFFYCNTSNLFNGTYNGTYI
NISTNSNSTITLQCRIKQIINMWQGVGRAMYAPPIAGNITCKSNITGLLLTRDGGTKNNSNEETFRPAGGDMRDNWR
SELYKYKVVEIQPLGIAPTGAKERVVEREKE**GYRIQDPDX

>HV1300914_CH848.3.d0358.80.06D11gp120

MRVMGIPKNYPQWWIWGILGFWMLMICNGVPVWKEAKTTLFCASDAKAYEKEVHNVWATHACVPTDPSPQELVLKNV
TENFNMWKNDMVDQMHEDIISLWDQSLKPCVKLTPLCVTLNCSNARSNVNVTSINNTIMGEMKNCSFNTTTEIRDKE
KKEYALFYKPDVVPLNETSNTSEYRLINCNTSAVTQACPKVTFEPIPIHYCAPAGYAILKCNNKTFNGTGPCSNVST

Figure 6 continued

VQCTHGIRPVVSTQLLLNGSLAEKEIVIRSENLTNNAKIIIVHLNTSVEIVCTRPGNNTRKSVRIGPGQTFYATGDI
IGDIRQAHCNISEGQWNKTLHEVSKELQKHFPNKTIKYERSAGGDMEIATHSFNCGGEFFYCNTSNLFNGTYNGTYI
NTSSTSYITLQCRIKQIINMWQGVGRAMYAPPIAGNITCKSNITGLLLTRDGGTKNNSNEETFRPAGGDMRDNWRSE
LYKYKVVEIQPLGIAPTGAKERVVEREKE**GYRIQVPDX

>HV1300915_CH848.3.d0358.80.17D11gp120

MRVMGILKNYPQWWIWGILGFWMLMNCNGVPVWKEAKTTLFCASDAKAYKKEVHNVWATHACVPTDPSPQELVLENV
TENFNMWKNDMVDQMHEDIISLWDQSLKPCVKLTPLCVTLNCSNARSNVNVTSINNTIMGEMKNCSFNTTTEIRDKE
KKEYALFYRPDVVPLNETSNTSEYRLINCNTSAVTQACPKVTFEPIPIHYCAPAGYAILKCNNETFNGTGPCSNVST
VQCTHGIRPVVSTQLLLNGSLAEKEIVIRSENLTNNAKIIIVHLNTSVEIVCTRPGNNTRKSVRIGPGQTFYATGDI
IGDIRQAHCNISEEKWNKTLQQVGKELQKHFPNKTIKYERSAGGDMEITTHSFNCGGEFFYCNTSNLFNGTYNGTYI
NISTNSNSTITLQCRIKQIINMWQGVGRAMYAPPIAGNITCKSNITGLLLTRDGGTKNNSNEETFRPAGGDMRDNWR
SELYKYKVVEIQPLGIAPTGAKERVVEREKE**GYRIPDLDX

>HV1300916_CH848.3.d0358.80.44D11gp120

MRVMGILKNYPRWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLNCSNARSNVNVTSINNTIMGEMKNCSFNTTTEIRDKE
KKEYALFYKPDVVPLNETSNTSEYRLINCNTSAVTQACPKVTFEPIPIHYCAPAGYAILKCNNKTFNGTGPCSNVST
VQCTHGIRPVVSTQLLLNGSLAEKEIVIRSENLTNNAKIIIVHLNTSVEIVCTRPGNNTRKSVRIGPGQTFYATGDI
IGDIRQAHCNISEEKWNKTLQEVGKELQKHFPNKTIKYERSAGGDMEIATHSFNCGGEFFYCNTSNLFNGTYNGTDI
STNSNSTITLQCRIKQIINMWQGVGRAMYAPPIAGNITCKSNITGLLLTRDGGTKNNSNEETFRPAGGDMRDNWRSE
LYKYKVVEIQPLGIAPTGAKERVVEREKE**GYRIPVLDX

>HV1300917_CH848.3.d0445.25.04D11gp120

MRVMGIPKNYPQWWIWGILGFWMLMNCNGVPVWKEAKTTLFCASDAKAYKKEVHNVWATHACVPTDPSPQELVLDNV
TENFNMWKNDMVDQMHEDIISLWDQSLKPCVKLTPLCVTLNCSNVNVVNVTNITNTIKGEMKNCSFNTTTEIRDKEK
KEYALFYRPDVVPLNETSNTSEYRLINCNTSAVTQACPKVTFEPIPIHYCAPAGYAILKCNNETFNGTGPCSNVSTV
QCTHGIRPVVSTQLLLNGSLAEKGIVIRSENLTNNAKIIVQLNTSVEIVCTRPGNNTRKSVRIGPGQTFYATGDII
GDIRQAHCNISEEKWNKTLHEVSKELQKHFPNKTIKYERSAGGDMEIATHSFNCGGEFFYCNTSKLFNGTYNGTYIS
TNSTSYITLQCRIKQIINMWQGVGRAMYAPPIAGNITCKSNITGLLLTRDGGTNNNSNEETFRPAGGDMRDNWRSEL
YKYKVVEIQPLGIAPTGAKERVVEREKE**GTRIR*PDX

>HV1300918_CH848.3.d0445.25.18D11gp120

MRVMGIPKNYPQWWIWGILGFWMLMNCNGVPVWKEAKTTLFCASDAKAYKKEVHNVWATHACVPTDPSPQELVLKNV
TENFNMWKNDMVDQMHEDIISLWDQSLKPCVKLTPLCVTLNCSNVNVVNVTNITNTIKGEMKNCSFNTTTEIRDKEK
KEYALFYRPDVVPLNETSNTSEYRLINCNTSAVTQACPKVTFEPIPIHYCAPAGYAILKCNNETFNGTGPCSNVSTV
QCTHGIRPVVSTQLLLNGSLAEKEIVIRSENLTNNAKIIIVHLHTPVEIVCTRPGNNTRKSVRIGPGQTFYATGDII
GDIRQAHCNISEEKWNKTLQEVGKELQKHFPNKTIKYERSAGGDMEITTHSFNCGGEFFYCNTSNLFNGTYNGPYIN
ISTNSNSTITLQCRIKQIINMWQGVGRAMYAPPIAGNITCKSNITGLLLTRDGGTKNNSNEETFRPAGGDMRDNWRS
ELYKYKVVEIQPLGIAPTGAKERVVEREKE**GTRIRSPDXX

>HV1300919_CH848.3.d0445.25.26D11gp120

MRVMGILKNYPQWWIWGILGFWMLMICNGVPVWKEAKTTLFCASDAKAYEKEVHNVWATHACVPTDPSPQELVLKNV
TENFNMWKNDMVDQMHEDIISLWDQSLKPCVKLTPLCVTLDCSNVNVVNVTNITNTIKGEMKNCSFNTTEIRDREK
KEYALFYRPDVVPLNETSNTSEYRLINCNTSAVTQACPKVTFEPIPIHYCAPAGYAILKCNNETFNGTGPCSNVSTV
QCTHGIRPVVSTQLLLNGSLAEKEIVIRSENLTNNAKIIIVHLNTPVEIVCTRPGNNTRKSVRIGPGQTFYATGDII
GDIRQAHCNISEKQWNETLQKVGKELQKHFPNKTIKYERSAGGDMEITTHSFNCGGEFFYCNTSNLFNGTYNGTYIN
ISTNSNSTITLQCRIKQIINMWQGVGRAMYAPPIAGNITCRSNITGLLLTRDGGTKNNSNEETFRPAGGDMRDNWRS
ELYKYKVVEIQPLGIAPTGAKERVVEREKE**GTRIR*PDXX

MRVMGILKNYPQWWIWGILGFWMLMICKGVPVWKEAKTTLFCASDAKAYEKEMHNVWATHACVPTDPSPQELFLENV
TENFNMWKNDMVDQMHEDIISLWDQSLKPCVKLTPLCVTLNCSNVSNVNVTNITNTIKGEMKNCSFNTTTEIRDKEK
KEYALFYRPDVVPLNETSNTSEYRLINCNTSAVTQACPKVTFEPIPIHYCAPAGYAILKCNNETFNGTGPCSNVSTV
QCTHGIRPVVSTQLLLNGSLAEKEIVIRSENLTNNAKIIVHLNTSVEIVCTRPGNNTRKSVRIGPGQTFYATGDII
GDIRQAHCNISEEKWNKTLQQVGKELQKHFPNKTIKYERSAGGDMEIATHSFNCGGEFFYCNTSNLFNGTYNGTYST
NSTSTITLQCRIKQIINMWQGVGRAMYAPPIAGNITCKSNITGLLLTRDGGTKNNSNEETFRPAGGDMRDNWRSELY
KYKVVEIQPLGIAPTGAKERVVEREKE**GTRIRLPDX

>HV1300921_CH848.3.d0445.30.42D11gp120

MRVMGILKNYPPWWIWGILGFWMLMICNGVPVWKEAKTTLFCASDARAYEKEVHNVWATHACVPTDPSPQELVLGNV
TENFNMWKNDMVDQMHEDIISLWDQSLKPCVKLTPLCVTLNCSNVNVVNVTNITNTIKGEMKNCSFNTTTEIRDKEK
KEYALFYKPDVVPLNETSNTSEYRLINCNTSAVTQACPKVTFEPIPIHYCAPAGYAILKCNNETFNGTGPCSNVSTV
QCTHGIRPVVSTQLLLNGSLAEKEIVIRSENLTNNAKIIVHLNTSVEIVCTRPGNNTRKSVRIGPGQTFYATGDII
GDIRQAHCNISEEKWNKTLHEVSKELQKHFPNKTIKYERSAGGDMEIATHSFNCGGEFFYCNTSNLFNGTYNGTYIS
TNSSANSNSTITLQCRIKQIINMWQGVGRAMYAPPIAGNITCKSNITGLLLTRDGGTKNNSNEETFRPAGGDMRDNW
RSELYKYKVVEIQPLGIAPTGAKERVVEREKE**GSRIR*PDX

>HV1300922_CH848.3.d0526.25.02D11gp120

MKVMGILKNYPQWWIWGILGFWMLMICKGVPVWKEAKTTLFCASDARAYEKEVHNVWATHACVPTDPSPQELFLENV
TENFNMWKNDMVDQMHEDIISLWDQSLKPCVKLTPLCVTLICSNATVNNRTAYDTRSNVNVTSINNTIMGEMKNCSF
NTTTEIRDKEKKEYALFYKPDIVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEKQWNETLQKVGKELQKHFPNKTIKYERSAGGDMEIATHSFNCGGEFFYCNTSKL
FNGTYNGTDINISTNSNSTITLQCRIKQIINMWQGVGRAMYAPPIAGNITCKSNITGLLLTRDGGTNSNKTEETFRP
AGGDMRDNWRSELYKYKVVEIQPLGIAPTGAKERVVEREKE**EDPNSVTGS

>HV1300923_CH848.3.d0526.25.09D11gp120

MRVMGILKNYPQWWIWGILGFWMLMICNGVPVWKEAKTTLFCASDARAYEKEVHNVWATHACVPTDPSPQELFLENV
TENFNMWKNDMVDQMHEDIISLWDQSLKPCVKLTPLCVTLNCSNVNVTGSNVNVTNITNTITGEMKNCSFNTTTEIR
DKEKKEYALFYKPDVVPLNETSNTSEYRLINCNTSAVTQACPKVTFEPIPIHYCAPAGYAILKCNNETFNGTGPCSN
VSTVQCTHGIRPVVSTQLLLNGSLAEKGIVIRSENLTNNAKIIIVQLNTSVEIVCTRPGNNTRKSVRIGPGQTFYAT
GGIIGDIRQAHCNISESKWNETLHEVSKELQKHFPNKTIKYERSAGGDMEITTHSFNCGGEFFYCNTSNLFNGTYNG
TYNGTNSNSTITLQCRIKQIINMWQGVGRAMYAPPIAGNITCRSNITGLLLTRDGGTNSNKTEETFRPAGGDMRDNW
RSELYKYKVVEIQPLGIAPTGAKERVVEREKE**EVPNSVTGS

>HV1300924_CH848.3.d0526.25.10D11gp120

MRVMGIPKNYPQWWIWGILGFWMLMNCNGVPVWKEAKTTLFCASDAKAYKKEVHNVWATHACVPTDPSPQELVLKNV
TENFNMWKNDMVDQMHEDIISLWDQSLKPCVKLTPLCVTLNCSNVNVVNVTNITNTIKGEMKNCSFNTTTEIRDKEK
KEYALFYRPDVVPLNETSNTSEYRLINCNTSAVTQACPKVTFEPIPIHYCAPAGYAILKCNNETFNGTGPCSNVSTV
QCTHGIRPVVSTQLLLNGSLAEKEIVIRSENLTNNAKIIIVHLNTSVEIVCTRPGNNTRKSVRIGPGQTFYATGDII
GDIRQAHCNISEEKWNKTLQQVGKELQKHFPNKTIKYERSAGGDMEITTHSFNCGGEFFYCNTSNLFNGTYNGKYIN
ISTNSNSTITLQCRIKQIINMWQGVGRAMYAPPIAGNITCKSNITGLLLTRDGGTKNNSTETEETFRPAGGDMRDNW
RSELYKYKVVEIQPLGIAPTGAKERVVEREKE**GT*IR*PDX

>HV1300925_CH848.3.d0526.25.11D11gp120

MRVMGILKNCPQWWIWGILGFWMLMICNGVPVWKEAKTTLFCASDAKAYKKEVHNVWATHACVPTDPSPQELVLKNV
TENFNMWKNDMVDQMHEDIISLWDQSLKPCVKLTPLCVTLICSNATVNNRTVYDTRSNVSVTSINNTIMGEMKNCSF
NTTTEIRDKEKKEYALFYRPDIVPLNETSNTSEYPLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTPVEIVCTRPSNNTRKSVRIGP
GQTFYATGDIIGDIRQAHCNISEEKWNKTLQKVGKELQKHFPNKTIKYERSAGGDMEITTHSFNCGGEFFYCNTSNL
FNGTYNGTYTNISTNSNSTITLQCRIKQIINMWQGVGRAMYAPPIAGNITCRSNITGLLLTRDGGTNSNKTEETFRP
AGGDMRDNWRSELYKYKVVEIQPLGIAPTGAKERVVEREKE**GS*IR*PDX

MRVMGIPKNYPQWWIWGILGFWMLMNCNGVPVWKEAKTTLFCASDAKAYKKEVHNVWATHACVPTDPSPQELVLKNV
TENFNMWKNDMVDQMHEDIISLWDQSLKPCVKLTPLCVTLNCVNVTNITNTIKGEMKNCSFNTTTEIRDKEKKEYAL
FYRPDVVPLNETSNTSEYRLINCNTSAVTQACPKVTFEPIPIHYCAPAGYAILKCNNETFNGTGPCSNVSTVQCTHG
IRPVVSTQLLLNGSLAEKGIVIRSENLTNNAKIIIVQLNTSVEIVCTRPGNNTRKSVRIGPGQTFYATGDIIGDIRQ
AHCNISEEKWNKTLQQVGKELQKHFPNKTIKYERSAGGDMEITTHSFNCGGEFFYCNTSNLFNGTYNGTYNGSTNSN
STITLQCRIKQIINMWQGVGRAMYAPPIAGNITCRSNITGLLLTRDGGTNSNKTEETFRPAGGDMRDNWRSELYKYK
VVEIQPLGIAPTGAKERVVEREKE**GSRIRSPDX

>HV1300927_CH848.3.d0526.25.32D11gp120

MRVMGIPKNYPQWWIWGILGFWMLMNCNGVPVWKEAKTTLFCASDARAYEKEVHNVWATHACVPTDPSPQELFLENV
TENFNMWKNDMVDQMHEDIISLWDQSLKPCVKLTPLCVTLICSNATVNNRTVYDTRSNANVTSINNTIMGEMKNCSF
NTTTEIPDKEKKEYALFYRPDIVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLHTPVEIVCTRPGNNTRKSVRIGP
GQTFYATGDIIGDIRQAHCNISEEKWNKTLQKVGKELQKHFPNKTIKYERSAGGDMEITTHSFNCGGEFFYCNTSNL
FNGTYNGTYNGTNSNSTITLQCRIKQIINMWQGVGRAMYAPPIAGNITCRSNITGLLLTRDGGTNSNKTEETFRPAG
GDMRDNWRSELYKYKVVEIQPLGIAPTGAKERVVEREKE**EDPNSVTGS

>HV1300928_CH848.3.d0526.25.39D11gp120

MRVMGIPKNYPQWWIWGILGFWMLMICSGVPVWKEAKTTLFCASDAKAYEKEMHNVWATHACVPTDPSPQELFLENV
TENFNMWKNDMVDQMHEDIISLWDQSLKPCVKLTPLCVTLICSNATVNNRTVYDTRSNVNVTSINNTIMGEMKNCSF
NTTTEIRDKEKKEYALFYKPDIVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTPVEIVCTRPGNNTRKSVRIGP
GQTFYATGDIIGDIRQAHCNISEEKWNKTLQKVGKELQKHFPNKTIKYERSAGGDMEITTHSFNCGGEFFYCNTSKL
FNGTYNGINISTNSNSTITLQCRIKQIINMWQGVGRAMYAPPIAGNITCKSNITGLLLTRDGGNRNNSNEETFRPAG
GDMRDNWRSELYKYKVVEIQPLGIAPTGAKERVVEREKE**EVPNSVTGS

>HV1300929_CH848.3.d0611.9.02D11gp120

MRVMGIPKNYPQWWIWGILGFWMLMNCNGVPVWKEAKTTLFCASDAKAYKKEVHNVWATHACVPTDPSPQELVLKNV
TENFNMWKNDMVDQMHEDIISLWDQSLKPCVKLTPLCVTLICSNATVNNRTVYEMKNCSFNTTTEIRDKEKKEYALF
YRPDIVPLGETSNTSEYRLINCNTSAVTQACPKVTFEPIPIHYCAPAGYAILKCNNETFNGTGPCSNVSTVQCTHGI
RPVVSTQLLLNGSLAEKGIVIRSENLTNNAKIIIVHLHTPVEIVCTRPGNNTRKSVRIGPGQTFYATGDIIGDIRQA
HCNISEEKWNETLQKVGKELQKHFPNKTIKYAQSAGGDMEITTHSFNCGGEFFYCNTSKLFNGTYNGAYINISTNSN
STITLQCRIKQIINMWQGVGRAMYAPPIAGNITCKSNITGLLLTRDGGTNNKTEEIFRPAGGDMRDNWRSELYKYKV
VEIQPLGIAPTGAKERVVEREKE**GT*IRSPDX

>HV1300930_CH848.3.d0611.20.12D11gp120

MRVMGIPKNYPQWWIWGILGFWMLMNCNGVPVWKEAKTTLFCASDAKAYKKEVHNVWATHACVPTDPSPQELFLENV
TENFNMWKNDMVDQMHEDIISLWDQSLKPCVKLTPLCVTLICSNATVNNRTMGEMKNCSFNTTTEIRDKEKKEYALF
YKPDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLNTPVEIVCTRPGNNTRKSVRIGPGQTFYATGAIIGDIRQA
HCNISESKWNETLQKVGKELQKHFPNKTIKYEQSAGGDMEITTHSFNCGGEFFYCNTSKLFNGTYNGAYINISTNSN
STITLQCRIKQIINMWQGVGRAMYAPPIAGNITCKSNITGLLLTRDGGTNNKTEEIFRPAGGDMRDNWRSELYKYKV
VEIQPLGIAPTGAKERVVEREKE**GS*IRSPDX

>HV1300931_CH848.3.d0611.20.14D11gp120

MKVMGIPKNYPQWWIWGILGFWMLMNCNGVPVWKEAKTTLFCASDAKAYKKEVHNVWATHACVPTDPSPQELVLGNV
TENFNMWKNDMVDQMHEDIISLWDQSLKPCVKLTPLCVTLICSNATVNNRTVYEMKNCSFNTTTEIRDKEKKEYALF
YRPDIVPLNETSNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLHTPVEIVCTRPGNNTRKSVRIGPGQTFYATGDIIGDIPQA
HCNISEKQWNETLQKVGKELQKHFPNKTIKYERSAGGDMEITTHSFNCGGEFFYCNTSKLFNGTYNGTDISTNSSAN

Figure 6 continued

SNSTITLQCRIKQIINMWQGVGRAMYAPPIAGNITCKSNITGLLLTRDGGTNSSEEIFRPAGGDMRDNWRSELYKYK
VVEIQPLGIAPTGAKERVVEREKE**GSRIR*PDXX

>HV1300932_CH848.3.d0611.20.28D11gp120

MRVMGILKNCPQWWIWGILGFWMLMICNGVPVWKEAKTTLFCASDARAYEKEVHNVWATHACVPTDPSPQELVLDNV
TENFNMWKNDMVDQMHEDIISLWDQSLKPCVKLTPLCVTLICSNATVNNRTVYEMKNCSFNTTTEIRDKEKKEYALF
YRPDIVPLNETSNTSEYRLINCNTSAVTQACPKVTFEPIPIHYCAPAGYAILKCNNKTFNGTGPCSKVSTVQCTHGI
RPVVSTQLLLNGSLAEKEIVIRSENLTNNAKIIIVHLHTPVEIVCTRPGNNTRKSVRIGPGQTFYATGDIIGDIRQA
HCNISEEKWNETLQKVGKELQKHFPNKTIKYAQSAGGDMEITTHSFNCGGEFFYCNTSKLFNGTYNGAYINISTNSN
STITLQCRIKQIINMWQGVGRAMYAPPIAGNITCKSNITGLLLTRDGGTNNKTEEIFRPAGGDMRDNWRSELYKYKV
VEIQPLGIAPTGAKERVVEREKE**EDPNSVTGS

>

>HV1300933_CH848.3.d0700.15.06D11gp120

MRVMGIPKNYPQWWIWGILGFWMLMNCNGVPVWKEAKTTLFCASDAKAYKKEVHNVWATHACVPTDPSPQELVLKNV
TENFNMWKNNRVDQMHEDIISLWDQSLKPCVKLTPLCVTLICSNATVDNRTVGEMKNCSFNTTTEIRDKEKKEYALF
YKPDVVPLDETNNTSEYRLINCNTSAVTQACPKVTFEPIPIHYCAPAGYAILKCNNETFNRTGPCSNVSTVQCTHGI
RPVVSTQLLLNGSLAEKEIVIRSENLTNNAKIIIVHLNTPVEIVCTRPNNNTRKSVRIGPGQTFYATGGIIGDIRQA
HCNISEGQWNETLQKVGKELQKHFPNKTIKYEQSAGGDMEITTHSFNCGGEFFYCNTSKLFNGTYNGTYISTNSSTN
STSTITLQCRIKQIINMWQGVGRAMYAPPIAGNITCKSNITGLLLTRDGGTNSSEEIFRPAGGDMRDNWRSELYKYK
VVEIQPLGIAPTGAKERVVEREKE**EVPNSVTGS

>HV1300934_CH848.3.d0700.15.15D11gp120

MRVTGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVNNRTVYDSRSNDNVTSINNTIMGEMKNCSF
NTTTEIRDKEKKEYALFYRPDIVPLNETSNTSEYRLINCNTSAVTQACPKVTFEPIPIHYCAPAGYAILKCNDETFN
GTGPCSNVSTVQCTHGIRPVVSTQLLLNGSLAEKEIVIRSENLTNNAKIIIVHLHTPVEIVCTRPGNNTRKSVRIGP
GQTFYATGDIIGDIRQAHCNISEEKWNKTLQKVGKELQKHFPNKTIKYERPAGGDLEITTHSFNCGGEFFYCNTSKL
FNGTYNGTDISTNSSTNSTSTITLQCRIKQIINMWQGVGRAMYAPPIAGNITCKSNITGLLLTRDGGTNSSEEIFRP
AGGDMRDNWRSELYKYKVVEIQPLGIAPTGAKERVVEREKE**GT*IR*PDX

>HV1300935_CH848.3.d0700.15.29D11gp120

MRVMGILKNYPQWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSNATVNNRTVYDSRSNDNVTSINNTIMGEMKNCSF
NTTTEIRDKEKKEYALFYRPDIVPLNENETSNTSEYRLINCNTSAVTQACPKVTFEPIPIHYCAPAGYAILKCNNET
FNGTGPCSNVSTVQCTHGIRPVVSTQLLLNGSLAEKEIVIRSENLTNNAKIIIVHLHTPVEIVCTRPGNNTRKSVRI
GPGQTFYATGDIIGDIRQAHCNISEEKWNETLQKVGKELQKHFPNKTIKYAQSAGGDMEITTHSFNCGGEFFYCNTS
NLFNGTYNGTYISTNSSANSTSTITLQCRIKQIINMWQGVGRAMYAPPIAGNITCKSNITGLLLTRDGGTNNTSNEE
TFRPAGGDMRDNWRSELYKYKVVEIQPLGIAPTGAKERVVEREKE**GS*IR*PDX

>HV1300936_CH848.3.d0700.27.06D11gp120

MRVMGILKNYPQWWIWGILGFWMLMICKGVPVWKEAKTTLFCASDAKAYEKEVHNVWATHACVPTDPSPQELFLENV
TENFNMWKNDMVDQMHEDIISLWDQSLKPCVKLTPLCVTLICSNATVNNRTVYEMKNCSFNTTTEIRDKEKKEYALF
YRSDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLHTPVEIVCTRPGNNTRKSVRIGPGQTFYATGDIIGEIRQA
HCNISESKWNETLQKVGKELQKHFPNKTIKYERSAGGDMEITTHSFNCGGEFFYCNTSKLFNGTYNGTDISTNSSAN
SNSTITLQCRIKQIINIWQGVGRAMYAPPIAGNITCKSNITGLLLTRDGGNNNNRNEETFRPAGGDMRDNWRSELYK
YKVVEIQPLGIAPTGAKERVVEREKE**GSRIRLPDXX

MRVMGIPKNYPQWWIWGILGFWMLMNCNGVPVWKEAKTTLFCASDARAYEKEVHNVWATHACVPTDPSPQELVLGNV
TENFNMWKNDMVDQMHEDIISLWDQSLKPCVKLTPLCVTLICSNATVDNRTVGEMKNCSFNTTTEIRDKEKKEYALF
YRPDIVPLSETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLNTPVEIVCTRPNNNTRKSVRIGPGQTFYATGDIIGEIKQA
HCNISEEKWNETLQKVGKELQKHFPNKIIKYAQSAGGDMEITTHSFNCGGEFFYCNTANLFNGTYNGTDISTNSSTK
SNSTITLQCRIKQIINMWQGVGRAMYAPPIAGNITCRSTITGLLLTRDGGTNSSKTEEETFRPAGGDMRDNWRSELY
KYKVVEIQPLGIAPTGAKERVVEREKE**EDPNSVTGS

>HV1300938_CH848.3.d0794.5.41D11gp120

MRVMGILKNYPQWWIWGILGFWMLMICNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVKNRTVEEMKNCSFNTTTEIRDKEKKEYALF
YRPDIVPLNNETSNTSEYRLINCNTSAVTQACPKVTFEPIPIHYCAPAGYAILKCNNETFNGTGPCSNVSTVQCTHG
IRPVVSTQLLLNGSLAEKEIVIRSENLTNNAKIIIVHLNTPVEIVCTRPNNNTRKSVRIGPGQTFYATGDIIGDIRQ
AHCNISEKEWNDTLQKVGKELQKHFPNKTIEYKQSAGGDMEITTHSFNCGGEFFYCNTSNLFNGTYNGTYMNISTDS
NSTITLQCRIKQIINMWQGVGRAMYAPPIAGNITCRSNITGLLLTRDGGTNSSKTEEETFRPAGGDMRDNWRSELYK
YKVVEIQPLGIAPTGAKERVVEREKE**EVPNSVTGS

>HV1300939_CH848.3.d0836.10.36D11gp120

MRVMGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVKNSTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKGIVIRSENLTNNAKIIIVHLNTPVEIVCTRPNNNTRKSVRIGPGQTFYATGDIIGDIRQ
AHCNISESKWNETLQKVGKELQKHFPNKTIKYEQSAGGDMEITTHSFNCGGEFFYCTTSKLFNGTYNGTDISTNSSA
NSNPTITLQCRIKQIINMWQGVGRAMYAPPIAGNITCKSNITGLLLTRDGGTNSSGKEEIFRPAGGDMRDNWRSELY
KYKVVEIQPLGIAPTGAKERVVEREKE**GT*IRLPDX

>HV1300940_CH848.3.d0864.7.26D11gp120

MRVTGILKNYPQWWIWGILGFWMLMNCNGVPVWKEAKTTLFCASDARAYEKEVHNVWATHACVPTDPSPQELVLGNV
TENFNMWKNDMVDQMHEDIISLWDQSLKPCVKLTPLCVTLICSNATVKNSTVDEMKNCSFNTTTEIRDKEKKEYALF
YRPDIVPLNENETSNTSEYRLINCNTSAVTQACPKVTFEPIPIHYCAPAGYAILKCNDETFNGTGPCSNVSTVQCTH
GIRPVVSTQLLLNGSLAEKEIVIRSENLTNNAKIIIVHLNTPVEIVCTRPNNNTRKSVRIGPGQTFYATGDIIGDIR
QAHCNISEKEWNETLQKVGKELQKHFPNKTIKYAQSAGGDMEITTHSFNCGGEFFYCNTANLFNGTYNGTDISTNSS
TKSNSTITLQCRIKQIINMWQGVGRAMYAPPIAGNITCRSTITGLLLTRDGGNNSSKTEEETFRPAGGDMRDNWRSE
LYKYKVVEIQPLGIAPTGAKERVVEREKE**GS*IRLPDX

>HV1300941_CH848.3.d0864.7.39D11gp120

MRVMGIPKNCPQWWIWGILGFWMLMICNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVKNSTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLNTPVEIVCTRPNNNTRKSVRIGPGQTFYATGDIIGDIRQ
AHCNISEKEWNDTLQKVGKELQKHFPNKTIEYKQSAGGDMEITTHSFNCGGEFFYCNTAKLFNGTYNGTDISTNSSA
DSNSTITLQCRIKQIINMWQGVGRAMYAPPIAGNITCKSHITGLLLTRDGGTNSSEEEEIFRPAGGDMRDNWRSELY
KYKVVEIQPLGIAPTGAKERVVEREKE**EFGDRDPDX

>HV1300942_CH848.3.d0893.10.06D11gp120

MRVTGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVKNSTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLNTPVEIVCTRPNNNTRKSVRIGPGQTFYATGDIIGDTRQ
AHCNISEKKWNETLQKVGIELQKHFPNKTIKYNQSAGGDMEITTHSFNCGGEFFYCNTSNLFNGTYNGTYISTNSSA
NSTSTITLQCRIKQIINMWQGVGRAMYAPPIAGNITCRSNITGLLLTRDGGTNSNETETFRPAGGDMRDNWRSELYK
YKVVEIQPLGIAPTGAKERVVEREKE**EFGHRDPDX

MRVTGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSHATVENSTTEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLHTPVEIVCTRPNNNTRKSVRIGPGQTFYATGGIIGEIRQ
AHCNISKETWNDTLQKVGKELQKHFPNKTIRYNQSAGGDMEITTHSFNCGGEFFYCNTAKLFNSTYNGTYISTNSTN
STSYITLQCRIKQIINMWQGVGRAMYAPPIAGNITCRSNITGLLLTRDGGTNSSEEEIFRPAGGDMRDNWRSELYKY
KVVEVQPLGIAPTGAKERVVEREKE**EFGNRDPDXX

>HV1300944_CH848.3.d1120.10.21D11gp120

MRVTGILKNYPQWWIWGILGFWMLMICNGVPVWKEAKTTLFCASDAKAYKKEVHNVWATHACVPTDPSPQELFLKNV
TENFNMWKNDMVDQMHEDIISLWDQSLKPCVKLTPLCVTLMCSNAIVKNSTTEEMKNCSFNTTTEIRDKEKKEYALF
YRPDIVPLNNKTSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLHTPVQIVCTRPNNNTRKSVRIGPGQTFYATGDIIGDPRQ
AHCNISEKKWNETLQKVGIELQKHFPNKTIKYNQSAGGDMEITTHSFNCGGEFFYCNTAKLFNSTYNGTYISTNSTD
STSNITLQCRIKQIINMWQGVGRAMYAPPIAGNITCRSNITGLLLTRDGGINNDSNETETFRPAGGDMRDNWRSELY
KYKVVEVQPLGIAPTGAKERVVEREKE**EFGYRDPDX

>HV1300945_CH848.3.d1120.10.24D11gp120

MRVMGILKNYPRWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSTATVNKSTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLHTPVEIVCTRPNNNTRKSVRIGPGQTFYATGGIVGDIPQ
AHCNISKGLWNDTLQKVGIELQKHFPNKTIKYNQSAGGDMEITTHSFNCGGEFFYCNTSNLFNGTYNGTYISTNSSA
NSTSYITLQCRIKQIINMWQGVGRAMYAPPIAGNITCRSNITGLLLTRDGGTTNNSNETETFRPAGGDMRDNWRSEL
YKYKVVEIQPLGIAPTGAKERVVEREKE**EFGDRVPDX

>HV1300946_CH848.3.d1120.10.32D11gp120

MRVTGILKNYPRWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSNAIVENGTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKGIVIRSENLTNNAKIIIVQLNTSVEIVCTRPNNNTRKSVRIGPGQTFYATGDIIGDPRQ
AHCNISKEKWNDTLQKVGKELQKHFPNKTIRYNQSAGGDMEITTHSFNCGGEFFYCNTAKLFNSTYNGTYISTNSTN
STSNITLQCRIKQIINMWQGVGRAMYAPPIAGNITCRSNITGLLLTRDGGTTNNSNETETFRPAGGDMRDNWRSELY
KYKVVEIQPLGIAPTGAKERVVEREKE**EFGDQDPDX

>HV1300947_CH848.3.d1120.10.41D11gp120

MRVMGIQKNYPRWWIWGILGFWMLMICNGVPVWKEAKTTLFCASDARAYEKEVHNVWATHACVPTDPSPQELVLGNV
TENFNMWKNDMVDQMHEDIISLWDQSLKPCVKLTPLCVTLICSNATVKNSTTEEMKNCSFNTTTEIRDKEKKEHALF
YRPDIVPLNNETGNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVQLNTSVEIVCTRPNNNTRKSVRIGPGQTFYATGDIIGDIKQ
AHCNISEEKWNDTLQKVGIELQKHFPNKTIKYNQSAGGDMEITTHSFNCGGEFFYCNTSKLFNSTYNGTYISTNSTN
STSYITLQCRIKQIINMWQGVGRAMYAPPIAGNITCRSNITGLLLTRDGGINNDSNETETFRPAGGDMRDNWRSELY
KYKVVEIQPLGIAPTGAKERVVEREKE**EFGDQVPDX

>HV1300948_CH848.3.d1305.10.13D11gp120

MRVTGILKNYPRWWIWGILGFWMLMICNGVPVWKEAKTTLFCASDARAYEKEVHNVWATHACVPTDPSPQELVLDNV
TENFNMWKNDMVDQMHEDIISLWDQSLKPCVKLTPLCVTLICSIATANGSTVEEMKNCSFNTTTEIRDKEKKEYALF
YRPDIVPLNNKTSNISEYRLINCNTSAVTQACPKVTFEPIPIHYCAPAGYAILKCNNETFNGTGPCSNVSTVQCTHG
IRPVVSTQLLLNGSLAEKEIVIRSENLTNNAKIIIVHLHTPVEIVCTRPNNNTRKSVRIGPGQTFYATGDIIGNPRQ
AHCNISKEPWNDTLQKVGKELQKHFPNKTIRYNQSAGGDMEITTHSFNCGGEFFYCNTSNLFNSTYNDTYISTNSSA

Figure 6 continued

NNSSTITLQCRIKQIINMWQGVGRAMYAPPIAGNITCKSNITGLLLTRDGGTDSNETETFRPAGGDMRDNWRSELYK
YKVVEIQPLGIAPTGAKERVVEREKE**EFGDRDLDX

>HV1300949_CH848.3.d1305.10.21D11gp120

MRVTGILKNYPRWWIWGILGFWMLMICNGVPVWKEAKTTLFCASDAKAYVKEVHNVWATHACVPTDPSPQELVLDNV
TENFNMWKNDMVDQMHEDIISLWDQSLKPCVKLTPLCVTLICSNATVENSTTEEMKNCSFNTTTEIRDKEKKEHALF
YRPDIVPLNNETGNTSEYRLINCNTSAVTQACPKVTFEPIPIHYCAPAGYAILKCNDETFNGTGPCSKVSTVQCTHG
IRPVVSTQLLLNGSLAEKGIVIRSENLTNNAKIIIVQLNTSVEIVCTRPNNNTRKSVRIGPGQTFYATGDIIGNIRQ
AHCNISESKWNDTLQKVGIELQKHFPNKTIKYNQSAGGDMEITTHSFNCGGEFFYCNTAKLFNSTYNGTYISTNSTN
STSKNITLQCRIKQIINMWQGVGRAMYAPPIAGNITCRSNITGLLLTRDGGTTNNSNETETFRPAGGDMRDNWRSEL
YKYKVVEVQPLGIAPTGAKERVVEREKE**EFGDRVLDX

>HV1300950_CH848.3.d1305.10.30D11gp120

MRVTGILKNYPQWWIWGILGFWMLMTCNGVPVWKEAKTTLFCASDAKAYKKEVHNVWATHACVPTDPSPQELFLENV
TENFNMWKNDMVDQMHEDIISLWDQSLKPCVKLTPLCVTLICSNATVDEMKNCSFNATTEIRDKKKKEYALF
YRSDVVPLDETNNTSEYRLINCNTSAVTQACPKVTFEPIPIHYCAPAGYAILKCNDETFNGTGPCSNVSTVQCTHGI
RPVVSTQLLLNGSLAEKEIVIRSENLTNNAKIIIVHLHTPVEIVCTRPGHNTRKSVRIGPGQTFYATGDIIGDIRQA
HCNINESEWNETLQKVGKELQKHFPNKTIKYEQSAGGDMEITTHSFNCGGEFFYCNTAELFNGTYNGTDISTNSSAN
STSTITLQCRIKQIINMWQGVGRAMYAPPIAGNITCRSNITGLLLTRDGGINNVSNETETFRPAGGDMRDNWRSELY
KYKVVEVQPLGIAPTGAKERVVEREKE**EFGHRVPDX

>HV1300951_CH848.3.d1305.10.35D11gp120

MRVTGIRKNCPQWWIWGILGFWMLMNCNGVPVWKEAKTTLFCASDAKAYVKEVHNVWATHACVPTDPSPQELFLKNV
TENFNMWKNDMVDQMHEDIISLWDQSLKPCVKLTPLCVTLICSTATVNNSKFEEMKNCSFNTTTEIRDKEKKEYALF
YRPDIVPLDNETSNISEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVHLHTPVEIVCTRPNNNTRKSVRIGPGQTFYATGDIIGNPRQ
AHCNISKERWNDTLQKVGKELQKHFPNKTIKYNQSAGGDMEITTHSFNCGGEFFYCNTSNLFNSTYNDTYISTNSTN
STSYITLQCRIKQIINMWQGVGRAMYAPPIAGNITCKSNITGLLLTRDGGINKDSNETETFRPAGGDMRDNWRSELY
KYKVVEVQPLGIAPTGAKERVVEREKE**EFGHQDPDX

>HV1300952_CH848.3.d1432.5.18D11gp120

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEEMSNATVKNSTTEEMSNATVKNST
TEEMKNCSFNTTTEIRDKEKKEYALFYRPDVVPLDETNNTSKYRLINCNTSAVTQACPKVTFEPIPIHYCAPAGYAI
LKCNDETFNGTGPCSKVSTVQCTHGIRPVVSTQLLLNGSLAEKEIVIRSENLTNNAKIIIVHLHTPVEIVCTRPYNN
TRKSVRIGPGQTFYATGDIIGDPRQAHCNISKEIWNKTLQEVGKELQKHFPNKTIRYNQSAGGDMEITTHSFNCGGE
FFYCNTSNLFNSTYNDTYISPNSTNSTSTITLQCRIKQIINMWQGVGRAMYAPPIAGNITCKSNITGLLLTRDGGIN
NVSNETETFRPAGGDMRDNWRSELYKYKVVEVQPLGLAPTGAKERVVEREKE**EFGHQVPDX

>HV1300953_CH848.3.d0794.5.27D11gp120

MRVMGIPKNYPQWWIWGILGFWMLMNCNGVPVWKEAKTTLFCASDARAYEKEVHNVWATHACVPTDPSPQELVLGNV
TENFNMWKNDMVDQMHEDIISLWDQSLKPCVKLTPLCVTLICSNATVDNRTVGEMKNCSFNTTTEIRDKEKKEYALF
YRPDIVPLSETNNTSAVTQACPKVTFEPIPIHYCAPAGYAILKCNNETFNGTGPCSNVSTVQCTHGI
RPVVSTQLLLNGSLAEKEIVIRSENLTNNAKIIIVHLNTPVEIVCTRPNNNTRKSVRIGPGQTFYATGDIIGEIKQA
HCNISEEKWNETLQKVGKELQKHFPNKIIKYAQSAGGDMEITTHSFNCGGEFFYCNTANLFNGTYNGTDISTNSSTK
SNSTITLQCRIKQIINMWQGVGRAMYAPPIAGNITCRSTITGLLLTRDGGTNSSKTEEETFRPAGGDMRDNWRSELY
KYKVVEIQPLGIAPTGAKERVVEREKE**EDPNSVTGS

>HV1300954_CH848.3.d1432.5.41D11gp120

MRVTGILRNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEEMSTALVKNSTTEAMKNCSFNTTT
EIRDKEKKEYALFYRPDIVPLNNETGNISEYRLINCNTSAVTQACPKVTFEPIPIHYCAPAGYAILKCNDETFNGTG

Figure 6 continued

PCSNVSTVQCTHGIRPVVSTQLLLNGSLAKEEIVIRSENLTNNAKIIIVHLHTPVEIVCTRPNNNTRKSVRIGPGQT
FYATGDIIGDPRKAHCNISEKDWNKTLQEVGKELQKHFPNKTIRYNQSAGGDMEITTHSFNCGGEFFYCNTSKLFNS
TYNDTYISTNSSANNSSTITLQCRIKQIINMWQGVGRAMYAPPIAGNITCKSNITGLLLTRDGGPDSNETETFRPAG
GDMRDNWRSELYKYKVVEVQPLGIAPTGAKERVVEREKE**EFGHRVLDX

>HV1300955_CH848.3.d1432.5.50D11gp120

MRVTGILKNYPQWWIWGILGFWMLMNCNGVPVWKEAKTTLFCASDAKAYEKEVHNVWATHACVPTDPSPQELFLENV
TENFNMWKNDMVDQMHEDIISLWDQSLKPCVKLTPLCVTLICSTATVNNSTVDEMKNCSFNATTEIRDKKKKEYALF
YRSDVVPLDETNNTSEYRLINCNTSAVTQACPKVTFEPIPIHYCAPAGYAILKCNDETFNGTGPCSNVSTVQCTHGI
RPVVSTQLLLNGSLAEKEIVIRSENLTNNAKIIIVHLHTPVEIVCTRPGHNTRKSVRIGPGQTFYATGDIIGDIRQA
HCNINESKWNETLQKVGNELQKHFPNKTIKYEQAAGGDMEITTHSFNCGGEFFYCNTANLFNGTYNGTDISTNSSAN
STSTITLQCKIKQIINMWQGVGRAMYAPPIAGNITCRSNITGLLLTRDGGINNVSNETETFRPAGGDMRDNWRSELY
KYKVVEVQPLGIAPTGAKERVVEREKE**EFGNRVPDXX

>HV1300956_CH848.3.d1432.5.56D11gp120

MRVTGILKNYPRWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEEMSNATVKNSTTEEMKNCSFNTTT
EIRDKEKKEYALFYRPDVVPLDETNNTSKYRLINCNTSAVTQACPKVTFEPIPIHYCAPAGYAILKCNDETFNGTGP
CSNVSTVQCTHGIRPVVSTQLLLNGSLAEKEIVIRSENLTNNAKIIIVHLHTPVEIVCTRPYNNTRKSVRIGPGQTF
YATGDIIGDPRQAHCNISKEIWNKTLQEVGKELQKHFPNKTIRYNQSAGGDMEITTHSFNCGGEFFYCNTAKLFNST
YNDTYKSTNSSANNSSIITLQCRIKQIINMWQGVGRAMYAPPIAGNITCKSNITGLLLTRDGGINNVSNETETFRPA
GGDNWRSELYKYKVVEVQPLGIAPTGAKERVVEREKE**EFGNQDPDX

>HV1300957_CH848.3.d1621.4.12D11gp120

MRVTGILKNYPRWWIWGILGFWMLMNCNGVPVWKEAKTTLFCASDAKAYVKEVHNVWATHACVPTDPSPQELFLKNV
TENFNMWKNDMVDQMHEDIISLWDQSLKPCVKLTPLCVTLNCSNATVNSTTDYDSRSNDTVTNITNTIKEEVKNCSF
KTTTEIRDKEKKEHALFYRPDIVPLNSETGNTSEYRLINCNTSAVTQACPKVTFEPIPIHYCAPAGYAILKCNDETF
NGTGPCSNVSTVQCTHGIRPVVSTQLLLNGSLAKEEIVIRSENLTNNAKTIIVHLHTPVEIVCTRPGNNTRKSMRIG
PGQTFYATGDIIGDIRQAHCNISEEKWNKTLQEVGKELQKHFPNRTIKYNQSAGGDMEITTHSFNCGGEFFYCNTSK
LFNSTYNDTYISTNSTNSSANNSSIITLQCRIKQIINMWQGVGRAMYAPPIAGNIICKSNITGLLLTRDGGPDSNKT
ETFRPAGGDMRDNWRSELYKYKVVEVQPLGIAPTGAKERVVEREKE**EFGNQVPDX

>HV1300958_CH848.3.d1621.4.15D11gp120

MRVTGILKNCPLWWIWGILGFWMLMNCNGVPVWKEAKTTLFCASDAKAYKKEVHNVWATHACVPTDPNPQEMFLKNV
TENFNMWKNDMVDQMHEDIISLWDQSLKPCVKLTPLCVTLNCSNATVNSTTDYDSRSNDSVTNITNTIKEEVKNCSF
KTTTEIRDKEKKEHALFYRPDIVPLNSETGNISEYRLINCNTSAVTQACPKVTFEPIPIHYCAPAGYAILKCNDETF
NGTGPCSNVSTVQCTHGIRPVVSTQLLLNGSLAKEEIVIRSENLTNNAKIIIVQLNTSVEIVCTRPGNNTPKSVRIG
PGQTFYATGDIIGDIRQAHCNISEKKWNETLQRVGIELQKHFPNKTIKYNQSAGGDMEITTHSFNCGGEFFYCNTAK
LFNSTYNGTYINTTSINSTLNITLQCRIKQIINMWQGVGRAMYAPPIAGNITCRSNITGLLLTRDGGIHNDSNETET
FRPAGGDMRDNWRSELYKYKVVEVQPLGIAPTGAKERVVEREKE**EFGNRDLDX

>HV1300959_CH848.3.d1621.4.25D11gp120

MRVTGILKNYPQWWIWGILGFWMLMNCNGVPVWKEAKTTLFCASDAKAYEKEVHNVWATHACVPTDPSPQELFLENV
TENFNMWKNDMVDQMHEDIISLWDQSLKPCVKLTPLCVTLICSTATVNNSTVDEMKNCSFNATTEIRDKKKKEYALF
YRSDVVSLDETNNTSEYRLINCNTSAVTQACPKVTFEPIPIHYCAPAGYAILKCNDETFNGTGPCSNVSTVQCTHGI
RPVVSTQLLLNGSLAEKEIVIRSENLTNNAKIIIVHLHAPVEIVCTRPGHNTRKSVRIGPGQTFYATGDIIGNIRQA
HCNINESEWNETLQKVGKELRKHFPNKTIKYEQSAGGDMEITTHSFNCGGEFFYCNTANLFNGTYNGTDISTNSSAD
PNSTITLECKIKQIINMWQGVGRAMYAPPIAGNITCRSNITGLLLTRDGGINNVSNATETFRPAGGDMRDNWRSELY
KYKVVEVQPLGIAPTGAKERVVEREKE**EFGNRVLDX

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSNATVENSTEAMKNCSFNTTTEIRDKIK
KERALFYRPDIVPLNDETNNTSKYRLINCNTSAVTQACPKVTFEPIPIHYCAPAGYAILKCNDETFNGTGPCSNVST
VQCTHGIRPVVSTQLLLNGSLAEKEIVIRSENLTNNAKIIIVHLHTPVQIVCTRPYNNTRKSVRIGPGQTFYATGDI
IGDPRKAHCNISEKDWNKTLQEVGKELQKHFPNKTIRYNQSAGGDMEITTHSFNCGGEFFYCNTSKLFNSTYNDTYI
STNSTNSSANNSSIITLQCRIKQIINMWQGVGRAMYAPPIAGNITCKSNITGLLLTRDGGPDNKTETFRPAGGDMRD
NWRSELYKYKVVEVQPLGIAPTGAKERVVEREKE**EFGYRVPDXX

>HV1300961_CH848.3.d1621.4.44D11gp120

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEKMSNVTVNNITIEEMKNCSFNTTT
EIRDKIKKERALFYRPDIVPLNDETNNTSKYRLINCNTSAVTQACPKVTFEPIPIHYCAPAGYAILKCNDETFNGTG
PCSNVSTVQCTHGIRPVVSTQLLLNGSLAEKEIVIRSENLTNNAKIIIVHLHAPVEIVCTRPYNNTRKSVRIGPGQT
FYATGDIIGDPRQAHCNISKEIWNKTLQEVGKELQKHFPNKTIRYNQSAGGDMEITTHSFNCGGEFFYCNTSNLFNS
TYNDTYISPNSTNSTSIITLQCKIKQIINMWQGVGRAMYAPPIAGNITCKSNITGLLLTRDGGINNVSNETETFRPA
GGDMRDNWRSELYKYKVVEVQPLGIAPTGAKERVVEREKE**EFGYQDPDX

>HV1300962_CH848.3.d1621.4.46D11gp120

MRVMGILKNYPRWWIWGILGFWMLMICNGVPVWKEAKTTLFCASDAKAYVKEVHNVWATHACVPTDPSPQELVLDNV
TENFNMWKNDMVDQMHEDIISLWDQSLKPCVKLTPLCVTLNCSNAIVKNSTTEELSNALAPNSTTEEMKNCSFNTTT
EIRDKEKKEYALFYRPDIVPLNNKTSNISEYRLINCNTSTVTQACPKVTFEPIPIHYCAPAGYAILKCNNETFNGTG
PCSNVSTVQCTHGIRPVVSTQLLLNGSLAKEGIVIRSENLTNNAKIIIVQLNANASVEIVCTRPNNNTRKSVRIGPG
QTFYATGDIIGNIRQAHCNISEKKWNETLQKVGIELQKHFPNKTIKYNQSAGGDMEITTHSFNCGGEFFYCNTAKLF
NSTYNGTYISTNSINSTLNITLQCRIKQIINMWQGVGRAMYAPPIAGNITCRSNITGLLLTRDGGIHNDSNETETFR
PAGGDMRDNWRSELYKYKVVEIQPLGIAPTGAKERVVEREKE**EFGYQVPDX

>HV1300963_CH848.3.d1635.10.35D11gp120

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEEISNATVKNITIKEMKNCSFNTTT
EIRDKIKKERALFYRTDIVPLNKETGNISEYRLINCNTSAVTQACPKVTFEPIPIHYCAPAGYAILKCNDETFNGTG
PCSNVSTVQCTHGIRPVVSTQLLLNGSLAEKEIVIRSENLTNNAKIIIVHLHNPVEIVCTRPYNNTRKSVRIGPGQT
FYATGDIIGDPRQAHCNISKEEWNKTLQEVGKELQKHFPNKTIRYNQSAGGDMEITTHSFNCGGEFFYCNTSNLFNS
TYNDTYISPNSTNSTSIITLQCRIKQIINMWQGVGRAMYAPPIAGNITCKSNITGLLLTRDGGINNVSNETETFRPA
GGDMRDNWRSELYKYKVVEVQPLGIAPTGAKERVVERGKE**EFGYRDLDX

>HV1300964_CH848.3.d1651.7.34D11gp120

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEKMSNVTVNNITIEEMKNCSFNTTT
EIRDKIKKERALFYRPDIVPLNDETNNTSKYRLINCNTSAVTQACPKVTFEPIPIHYCAPAGYAILKCNDETFNGTG
PCSNVSTVQCTHGIRPVVSTQLLLNGSLAEKEIVIRSENLTNNVKTIIVHLHAPVEIVCTRPYNNTRKSVRIGPGQT
FYATGDIIGDPRKAHCNISEKDWNKTLQEVGKELQKHFPNKTIRYNQSAGGDMEITTHSFNCGGEFFYCNTSKLFNS
TYNDTYISTNSTNSSANNSSIITLQCRIKQIINMWQGVGRAMYAPPIAGNITCKSNITGLLLTRDGGPDNKTETFRP
AGGDMRDNWRSELYKYKVVEVQPLGIAPTGAKERVVEREKE**EFGYRVLDX

>HV1300965_CH848.3.d1651.7.50D11gp120

MRVMGILKNYPRWWIWGILGFWMLMICNGVPVWKEAKTTLFCASDAKAYVKEVHNVWATHACVPTDPSPQELVLDNV
TENFNMWKNDMVDQMHEDIISLWDQSLKPCVKLTPLCVTLNCSNAIVKNSTTEELSNALARNSTTEEMKNCSFNTTT
EIRDKEKKEYALFYRPDIVPLNNKTSNISEYRLINCNTSTVTQACPKVTFEPIPIHYCAPAGYAILKCNNETFNGTG
PCSNVSTVQCTHGIRPVVSTQLLLNGSLAEKGIVIRSENLTNNAKIIIVQLNANASVEIVCTRPNNNTRKSVRIGPG
QTFYATGDIIGNIRQAHCNISEKKWNETLQKVGIELQKHFPNKTIKYNQSAGGDMEITTHSFNCGGEFFYCNTTKLF
NSTYNGTYISTNSINSTLNITLQCRIKQIINMWQGIGRAMYAPPIAGNITCRSNITGLLLTRDGGIHNDSNETETFR
PAGGDMRDNWRSELYKYKVVEIQPLGIAPTGAKERVVERGKE**GDRDPNSDX

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSNATVENSTEAMKNCSFNTTTEIRDKIK
KERALFYRPDIVPLNNETGNISEYRLINCNTSAVTQACPKVTFEPIPIHYCAPAGYAILKCNDETFNGTGPCSNVST
VQCTHGIRPVVSTQLLLNGSLAEKEIVIRSENLTNNAKIIIVHLHNPVEIVCTRPYNNTRKSVRIGPGQTFYATGDI
IGDPRKAHCNISKEEWNKTLQEVGKELQKHFPNKTIRYNQSAGGDMEITTHSFNCGGEFFYCNTSNLFNSTYNDTYI
SPNSTNSTSIITLQCRIKQIINNMWQGVGRAMYAPPIAGNITCKSNITGLLLTRDGGPESNETETFRPAGGDMRDNWR
SELYKYKVVEVQPLGIAPTGAKERVVEREKE**GHRDPNSDXX

>HV1300967_CH848.3.d1677.521.D11gp120

MRVTGILKNCPLWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSNATVGNSTEAMKNCSFNTTTEIRDKIK
KERALFYRPDIVPLNDETNNTSKYRLINCNTSAVTQACPKVTFEPIPIHYCAPAGYAILKCNDETFNGTGPCSNVST
VQCTHGIRPVVSTQLLLNGSLAEKEIVIRSENLTNNVKIIIVHLHTPVQIVCTRPYNNTRKSVRIGPGQTFYATGDI
IGDPRKAHCNISEKDWNKTLQEVGKELQKHFPNKTIRYNQSAGGDMEITTHSFNCGGEFFYCNTSKLFNSTYNDTYI
STNSTNSSANNSSIITLQCRIKQIINNMWQGVGRAMYAPPIAGNITCKSNITGLLLTRDGGPDNKTETFRPAGGDMRD
NWRSELYKYKVVEVQPLGIAPTGAKERVVEREKE**GNRDPNSDXX

>HV1300968_CH848.3.d1720.5D11gp120

MRVTGILKNCPLWWIWGILGFWMLMNCNGVPVWKEAKTTLFCASDAKAYVKEVHNVWATHACVPTDPSPQELVLDNV
TENFNMWKNDMVDQMHEDIISLWDQSLKPCVKLTPLCVTLNCSNAIVRNSTTEKMSDALDRNSTTEEMKNCSFNTTT
EIRDKEKKEYALFYRPDIVPLNNKTSNISEYRLINCNTSTVTQACPKVTFEPIPIHYCAPAGYAILKCNNETFNGTG
PCSNVSTVQCTHGIRPVVSTQLLLNGSLAKEEIVIRSENLTNNAKIIIVQLNANASVEIVCTRPNNNTRKSVRIGPG
QTFYATGDIIGDIRQAHCNISEKKWNETLQQVGIELQKHFPNKTIKYNQSAGGDMEITTHSFNCGGEFFYCNTAKLF
NSTYNGTYISTDSINSTLNITLQCRIKQIINMWQGVGRAMYAPPIAGNITCRSNITGLLLTRDGGIHNDSNVTETFR
PAGGDMRDNWRSELYKYKVVEIQPLGIAPTGAKERVVGREKE**GYRDPNSDX

>CH0848d0526.25.26D11gp120

MRVMGILKNYPQWWIWGILGFWMLMICNGVPVWKEAKTTLFCASDARAYEKEVHNVWATHACVPTDPSPQELFLENV
TENFNMWKNDMVDQMHEDIISLWDQSLKPCVKLTPLCVTLNCSNVNVTRSNVNVTNITNTIKGEMKNCSFNTTTEIR
DKEKKEYALFYRSDVVPLNETSNTSEYRLINCNTSAVTQACPKVTFEPIPIHYCAPAGYAILKCNNETFNGTGPCSN
VSTVQCTHGIRPVVSTQLLLNGSLAEKEIVIRSENLTNNAKIIIVHLHTPVEIVCTRPGNNTRKSVRIGPGQTFYAT
GDIIGDIRQAHCNISEEKWNKTLHEVSKELQKHFPNKTIKYAQSAGGDMEITTHSFNCGGEFFYCNTSNLFNGTYNG
TYISTNSSANSNSTITLQCRIKQIINNMWQGVGRAMYAPPIAGNITCRSNITGLLLTRDGGTKNNKTEETFRPAGGDM
RDNWRSELYKYKVVEIQPLGIAPTGAKERVVEREKE**GIX

>CH0848d0700.15.34D11gp120

MRVMGILKNYPQWWIWGILGFWMLMICNGVPVWKEAKTTLFCASDARAYEKEVHNVWATHACVPTDPSPQELVLGNV
TENFNMWKNDMVDQMHEDIISLWDQSLKPCVKLTPLCVTLICSNATVNNRTMGEMKNCSFNTTTEIRDKEKKEYALF
YKPDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLNTPVEIVCTRPNNNTRKSVRIGPGQTFYATGGIIGDIRQA
HCNISEGQWNETLQKVGKELQKHFPNKTIKYEQSAGGDMEITTHSFNCGGEFFYCNTSKLFNGTYNGTYISTNSSTN
STSTITLQCRIKQIINMWQGVGRAMYAPPIAGNITCKSNITGLLLTRDGGTNSSEEIFRPAGGDMRDNWRSELYKYK
VVEIQPLGIAPTGAKERVVEREKE**GIX

>CH0848d0780.25.05D11gp120

MRVMGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVNNRTDYDTRSNVNVTNITNTIKGEMKNCSF
NTTTEIRDKEKKEYALFYPPDIVPLNENETSNTSEYRLINCNTSAVTQACPKVTFEPIPIHYCAPAGYAILKCNDET
FNGTGPCSNVSTVQCTHGIRPVVSTQLLLNGSLAEKEIVIRSENLTNNAKIIIVHLNTSVEIVCTRPGNNTRKSVRI
GPGQTFYATGDIIGDIRQAHCNISESKWNETLQKVGIELQKHFPNKTIKYEQSAGGDMEITTHSFNCGGEFFYCNTS

Figure 6 continued

NLFNGTYNGTYISTNSSANSTSTITLQCRIKQIINMWQGVGRAMYAPPIAGNITCKSNITGLLLTRDGGTNSSEEIF
RPAGGDMRDNWRSELYKYKVVEIQPLGIAPTGAKERVVEREKE\*\*GIX

>CH0848d0700.15.05D11gp120

MRVMGILKNYPQWWIWGILGFWMLMICNGVPVWKEAKTTLFCASDAKAYKKEVHNVWATHACVPTDPSPQELVLGNV
TENFNMWKNDMVDQMHEDIISLWDQSLKPCVKLTPLCVTLICSNATVNNRTVYDSRSNDNVTSINNTIMGEMKNCSF
NTTTEIRDKEKKEYALFYRPDIVPLNENETSNTSEYRLINCNTSAVTQACPKVTFEPIPIHYCAPAGYAILKCNNET
FNGTGPCSNVSTVQCTHGIRPVVSTQLLLNGSLAEKEIVIRSENLTNNAKIIIVHLHTPVEIVCTRPGNNTRKSVRI
GPGQTFYATGDIIGDIRQAHCNISEEKWNETLQKVGIELQKHFPNKTIKYEQSAGGDMEITTHSFNCGGEFFYCNTS
NLFNGTYNGTYISTNSSANSTSTITLQCRIKQIINMWQGVGRAMYAPPIAGNITCKSNITGLLLTRDGGTNNTSNEE
TFRPAGGDMRDNWRSELYKYKVVEIQPLGIAPTGAKERVVEREKE\*\*GIX

>CH0848d0794.3.03D11gp120

MRVMGILKNYPQWWIWGILGFWMLMICNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVDNRTVGEMKNCSFNTTTEIRDKEKKEYALF
YRPDIVPLNNETSNTSEYRLINCNTSAVTQACPKVTFEPIPIHYCAPAGYAILKCNNETFNGTGPCSNVSTVQCTHG
IRPVVSTQLLLNGSLAEKGIVIRSENLTNNAKIIIVQLNTSVEIVCTRPNNNTRKSVRIGPGQTFYATGDIIGEIRQ
AHCNISEEKWNETLQKVGKELQKHFPNKTIKYAQSAGGDMEITTHSFNCGGEFFYCNTAKLFNGTYNGTDISTNSST
NSNPTITLQCRIKQIINMWQGVGRAMYAPPIAGNITCKSNITGLLLTRDGGTNSSGKEEIFRPAGGDMRDNWRSELY
KYKVVEIQPLGIAPTGAKERVVEREKE\*\*GIX

>CH0848d0836.10.31D11gp120

MRVMGILKNYPQWWIWGILGFWMLMICNGVPVWKEAKTTLFCASDAKAYKKEVHNVWATHACVPTDPSPQELFLKNV
TENFNMWKNDMVDQMHEDIISLWDQSLKPCVKLTPLCVTLICSNATVKNSTVEEMKNCSFNTTTEIRDKEKKEYALF
YRPDIVPLNNETSNTSEYRLINCNTSAVTQACPKVTFEPIPIHYCAPAGYAILKCNDETFNGTGPCSNVSTVQCTHG
IRPVVSTQLLLNGSLAEKGIVIRSENLTNNAKIIIVHLHTPVEIVCTRPNNNTRKSVRIGPGQTFYATGDIIGDIPQ
AHCNISESKWNETLQKVGKELQKHFPNKTIKYAQSAGGDMEITTHSFNCGGEFFYCNTAKLFNGTYNGTDISTNSST
NSNPTITLQCRIKQIINMWQGVGRAMYAPPIAGNITCKSNITGLLLTRDGGTNSSGKEEIFRPAGGDMRDNWRSELY
KYKVVEIQPLGIAPTGAKERVVEREKE\*\*GIX

>CH0848d0808.15.27D11gp120

MRVMGILKNYPQWWIWGILGFWMLMICNGVPVWKEAKTTLFCASDARAYEKEVHNVWATHACVPTDPSPQELFLDNV
TENFNMWKNDMVDQMHEDIISLWDQSLKPCVKLTPLCVTLICSNATVKNRTVYEMKNCSFNTTTEIRDKEKKEYALF
YRPDIVPLNENETSNTSEYRLINCNTSAVTQACPKVTFEPIPIHYCAPAGYAILKCNNETFNGTGPCSNVSTVQCTH
GIRPVVSTQLLLNGSLAEKEIVIRSENLTNNAKIIIVHLNTPVEIVCTRPNNNTRKSVRIGPGQTFYATGDIIGDIR
QAHCNISEKEWNETLQKVGKELQKHFPNKTIKYEQSAGGDMEITTHSFNCGGEFFYCNTSNLFNGTYNGTDISTNSS
AKSNSTITLQCRIKQIINMWQGVGRAMYAPPIAGNITCKSNITGLLLTRDGGNSSKTEEETFRPAGGDMRDNWRSEL
YKYKVVEIQPLGIAPTGAKERVVEREKE\*\*GIX

>CH0848d0949.10.18D11gp120

MRVMGILKNYPQWWIWGILGFWMLMICNGVPVWKEAKTTLFCASDARAYEKEVHNVWATHACVPTDPSPQELFLDNV
TENFNMWKNDMVDQMHEDIISLWDQSLKPCVKLTPLCVTLICSTATVDNSTVEEMKNCSFNTTTEIRDKEKKEYALF
YRPDIVPLNENETSNTSEYRLINCNTSAVTQACPKVTFEPIPIHYCAPAGYAILKCNDETFNGTGPCSNVSTVQCTH
GIRPVVSTQLLLNGSLAEKEIVIRSENLTNNAKIIIVHLHTPVEIVCTRPNNNTRKSVRIGPGQTFYATGDIIGEIR
QAHCNISEEEWNETLQKVGKELQKHFPNKTIKYEQSAGGDMEITTHSFNCGGEFFYCNTANLFNGTYNGTDISTNSS
TKSNSTITLQCRIKQIINMWQGVGRAMYAPPIAGNITCKSNVTGLLLTRDGGTNSSQTEEETFRPAGGDMRDNWRSE
LYKYKVVEIQPLGIAPTGAKERVVEREKE\*\*GIX

>CH0848d0808.15.25D11gp120

MRVMGILKNYPQWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSNATVKNRTVEEMKNCSFNTTTEIRDKEKKEYALF
YRPDIVPLNENETSNTSEYRLINCNTSAVTQACPKVTFEPIPIHYCAPAGYAILKCNDETFNGTGPCSNVSTVQCTH

Figure 6 continued

GIRPVVSTQLLLNGSLAEKEIVIRSENLTNNAKIIIVHLNAPVEIVCTRPNNDTRKSVRIGPGQTFYATGDIIGDIR
QAHCNISEKEWNETLQKVGIELQKHFPNKTIKYEQSAGGDMEITTHSFNCGGEFFYCNTSKLFNGTYNGTYINTSSN
STITLQCRIKQIINMWQGVGRAMYAPPIAGNITCKSDITGLLLTRDGGTNSSGKEEIFRPAGGDMRDNWRSELYKYK
VVEIQPLGIAPTGAKERVVEREKE**GIX

>CH0848d0864.3.03D11gp120

MRVMGILKNYPQWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSNTVNNRTVYEMKNCSFNTTTEIRDKEKKEYALFY
RPDIVPLNENETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVQLNTSVEIVCTRPNNNTRKSVRIGPGQTFYATGDIIGEIRQ
AHCNISEKEWNETLQKVGKELQKHFPNKTIKYAQSAGGDMEITTHSFNCGGEFFYCNTANLFNGTYNGTDISTNSST
KSNSTITLQCRIKQIINMWQGVGRAMYAPPIAGNITCRSTITGLLLTRDGGNSSKTEEETFRPAGGDMRDNWRSELY
KYKVVEIQPLGIAPTGAKERVVEREKE**GIX

>CH0848d0893.10.05D11gp120

MRVMGILKNYPQWWIWGILGFWMLMICNGVPVWKEAKTTLFCASDAKAYEKEVHNVWATHACVPTDPSPQELVLGNV
TENFNMWKNDMVDQMHEDIISLWDQSLKPCVKLTPLCVTLICSNTVNNRTVYEMKNCSFNTTTEIRDKEKKEYALFY
RPDIVPLNENETSNTSEYRLINCNTSAVTQACPKVTFEPIPIHYCAPAGYAILKCNDETFNGTGPCSNVSTVQCTHG
IRPVVSTQLLLNGSLAEKEIVIRSENLTNNAKIIIVQLNTSVEIVCTRPNNNTRKSVRIGPGQTFYATGDIIGEIRQ
AHCNISEEEWNDTLQKVGKELQKHFPNKTIEYKQSAGGDMEITTHSFNCGGEFFYCNTAKLFNGTYNGTDISTNSST
NSNPTITLQCRIKQIINMWQGVGRAMYAPPIAGNITCKSNITGLLLTRDGGNSSKTEEEIFRPAGGDMRDNWRSELY
KYKVVEIQPLGIAPTGAKERVVEREKE**GIX

>CH0848d0949.10.10D11gp120

MRVMGILKNYPQWWIWGILGFWMLMNCNGVPVWKEAKTTLFCASDAKAYKKEVHNVWATHACVPTDPSPQELFLDNV
TENFNMWKNDMVDQMHEDIISLWDQSLKPCVKLTPLCVTLICSNATVENKTVEEMKNCSFNTTTEIRDKEKKEYALF
YKPDVVPLDETNNTSEYRLINCNTSAVTQACPKVTFEPIPIHYCAPAGYAILKCNDETFNGTGPCSNVSTVQCTHGI
RPVVSTQLLLNGSLAEKEIVIRSENLTNNAKIIVHLTPVEIVCTRPNNNTRKSVRIGPGQTFYATGDIIGDIKQA
HCNISEKKWNETLQKVGIELQKHFPNKTIKYNQSAGGDMEITTHSFNCGGEFFYCNTSNLFNGTYNGTYISTNSSAN
STSTITLQCRIKQIINMWQGVGRAMYAPPIAGNITCRSNITGLLLTRDGGTNSNETETFRPAGGDMRDNWRSELYKY
KVVEIQPLGIAPTGAKERVVEREKE**GIX

>CH0848d0949.10.17D11gp120

MRVMGILKNYPQWWIWGILGFWMLMICNGVPVWKEAKTTLFCASDARAYEKEVHNVWATHACVPTDPSPQELVLGNV
TENFNMWKNDMVDQMHEDIISLWDQSLKPCVKLTPLCVTLICSNATVKNGTVEEMKNCSFNTTTEIRDKEKKEYALF
YKPDIVPLSETNNTSEYRLINCNTSAVTQACPKVTFEPIPIHYCAPAGYAILKCNDETFNGTGPCSNVSTVQCTHGI
RPVVSTQLLLNGSLAEKEIVIRSENLTNNAKIIVHLHTPVEIVCTRPNNNTRKSVRIGPGQTFYATGDIIGDIKQA
HCNISEEKWNDTLQKVGIELQKHFPNKTIKYNQSAGGDMEITTHSFNCGGEFFYCNTSNLFNGTYNGTYISTNSSAN
STSTITLQCRIKQIINMWQGVGRAMYAPPIAGNITCRSNITGLLLTRDGGTNSNETETFRPAGGDMRDNWRSELYKY
KVVEIQPLGIAPTGAKERVVEREKE**GIX

>CH0848d0808.15.15D11gp120

MRVMGILKNYPQWWIWGILGFWMLMICNGVPVWKEAKTTLFCASDARAYEKEVHNVWATHACVPTDPSPQELFLKNV
TENFNMWKNDMVDQMHEDIISLWDQSLKPCVKLTPLCVTLICSNATVKNRTVEEMKNCSFNTTTEIRDKEKKEYALF
YKPDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIIVHLNTPVEIVCTRPNNTRKSVRIGPGQTFYATGDIIGDIRQA
HCNISEKQWNDTLQKVGKELKKHFPNKTIKYAQSAGGDMEITTHSFNCGGEFFYCNTAKLFNGTYNGTDISTNSSAD
SNSTITLQCRIKQIINMWQGVGRAMYAPPIAGNITCKSHITGLLLTRDGGTNSSGKEEIFRPAGGDMRDNWRSELYK
YKVVEIQPLGIAPTGAKERVVEREKE**GIX

MRVMGILKNYPQWWIWGILGFWMLMICNGVPVWKEAKTTLFCASDARAYEKEVHNVWATHACVPTDPNPQELVLGNV
TENFNMWKNDMVDQMHEDIISLWDQSLKPCVKLTPLCVTLICSNATVKNRTVEEMKNCSFNTTTEIRDKEKKEYALF
YKPDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIVHLNTPVEIVCTRPNNNTRKSVRIGPGQTFYATGDIIGDIRQA
HCNISEKQWNDTLQKVGKELKKHFPNKTIKYAQSAGGDMEITTHSFNCGGEFFYCNTAKLFNGTYNGTDISTNSSAD
SNSTITLQCRIKQIINMWQGVGPRAMYAPPIAGNITCKSHITGLLLTRDGGTNSSEKEEIFRPAGGDMRDNWRSELYK
YKVVEIQPLGIAPTGAKERVVEREKE**GIX

>CH0848d0780.15.29D11gp120

MRVMGIPKNYPQWWIWGILGFWMLMICNGVPVWKEAKTTLFCASDAKAYKKEVHNVWATHACVPTDPNPQELVLGNV
TENFNMWKNDMVDQMHEDIISLWDQSLKPCVKLTPLCVTLICSNATVKNRTVEEMKNCSFNTTTEIRDKEKKEYALF
YKPDVVPLDETNNTSEYRLINCNTSAVTQACPKVTFEPIPIHYCAPAGYAILKCNNETFNGTGPCSNVSTVQCTHGI
RPVVSTQLLLNGSLAEKEIVIRSENLTNNAKIIVHLNTPVEIVCTRPNNNTRKSVRIGPGQTFYATGDIIGDIRQA
HCNISEKQWNDTLQKVGKELKKHFPNKTIKYAQSAGGDMEITTHSFNCGGEFFYCNTAKLFNGTYNGTDISTNSSAD
SNSTITLQCRIKQIINMWQGVGRAMYAPPIAGNITCKSHITGLLLTRDGGTNSSEKEEIFRPAGGDMRDNWRSELYK
YKVVEIQPLGIAPTGAKERVVEREKE**GIX

>CH0848d0808.15.43D11gp120

MRVMGILKNYPQWWIWGILGFWMLMICNGVPVWKEAKTTLFCASDAKAYKKEVHNVWATHACVPTDPSPQELFLKNV
TENLNMWKNDMVDQMHEDIISLWDQSLKPCVKLTPLCVTLICSNATVKNRTVEEMKNCSFNTTTEIRDKEKKEYALF
YRPDIVPLNENETSNTSEYRLINCNTSAVTQACPKVTFEPIPIHYCAPAGYAILKCNNETFNGTGPCSNVSTVQCTH
GIRPVVSTQLLLNGSLAEKEIVIRSENLTNNAKIIVHLHTPVEIVCTRPNNNTRKSVRIGPGQTFYATGDIIGDIR
QAHCNISEKQWNDTLQKVGKELQKHFPNKTIKYKHSAGGDMEITTHSFNCGGEFFYCNTSNLFNGTYNGTYMNISTD
SNSTITLQCRIKQIINMWQGVGRAMYAPPIAGNITCKSHITGLLLTRDGGTNSSGKEEIFRPAGGDMRDNWRSELYK
YKVVEIQPLGIAPTGAKERVVEREKE**GIX

>CH0848d1120.10.05D11gp120

MRVMGIPKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSTATVNKSTVEEMKNCSFNTTTEIRDKEKKEYALF
YRPDIVPLNNKTSNTSEYRLINCNTSAVTQACPKVTFEPIPIHYCAPAGYAILKCNDETFNGTGPCSNVSTVQCTHG
IRPVVSTQLLLNGSLAEEEIVIRSENLTNNAKIIIVHLHTPVEIVCTRPNNNTRKSVRIGPGQTFYATGGIIGDVRQ
AHCNISKGLWNDTLQKVGKELQKHFPNKTIRYNQSAGGDMEITTHSFNCGGEFFYCNTAKLFNGTYNGTDISTNSSA
NNSSTITLQCRIKQIINMWQGVGRAMYAPPIAGNITCKSNITGLLLTRDGGINSSREEEIFRPAGGDMRDNWRSELY
KYKVVEVQPLGIAPTGAKERVVEREKE**GIX

>CH0848d1432.5.06D11gp120

MRVMGIPKNYPRWWIWGILGFWMLMICNGVPVWKEAKTTLFCASDAKAYVKEVHNVWATHACVPTDPSPQELLLKNV
TENFNMWKNDMVDQMHEDIISLWDQSLKPCVKLTPLCVTLICSNATVENSTTDEMKNCSFNTTTEIRDKEKKERALF
YRPDIVPLNNETGNTSEYRLINCNTSAITQACPKVTFEPIPIHYCAPAGYAILKCNDETFNGTGPCSSVSTVQCTHG
IRPVVSTQLLLNGSLAEKGIVIRSENLTNNAKIIIVHLNASVEIVCTRPNNNTRKSVRIGPGQTFYATGDIIGDIRQ
AHCNISEKKWNETLQKVGIELQKHFPNKTIKYNQSAGGDMEITTHSFNCGGEFFYCNTAKLFNSTYNGTYISTNSIN
STLNITLQCRIKQIINMWQGVGRAMYAPPIAGNITCRSNITGLLLTRDGGIHNDSNETETFRPAGGDMRDNWRSELY
KYKVVEVQPLGIAPTGAKERVVEREKE**GIX

>CH0848d1432.5.48D11gp120

MRVMGIPKNYPRWWIWGILGFWMLMICNGVPVWKEAKTTLFCASDAKAYVKEVHNVWATHACVPTDPSPQELLLKNV
TENFNMWKNDMVDQMHEDIISLWDQSLKPCVKLTPLCVTLICSNATVENSTTDEMKNCSFNTTTEIRDKEKKERALF
YRPDIVPLNNETGNTSEYRLINCNTSAITQACPKVTFEPIPIHYCAPAGYAILKCNDETFNGTGPCSSVSTVQCTHG
IRPVVSTQLLLNGSLAEKGIVIRSENLTNNAKIIIVHLNASVEIVCTRPNNNTRKSVRIGPGQTFYATGDIIGDIRQ
AHCNISEKKWNETLQKVGIELQKHFPNKTIKYNQSAGGDMEITTHSFNCGGEFFYCNTAKLFNSTYNGTYISTNSIN
STLNITLQCRIKQIINMWQGVGRAMYAPPIAGNITCRSNITGLLLTRDGGIHNDSNETETFRPAGGDMRDNWRSELY
KYKVVEIQPLGIAPTGAKERVVEREKE**GIX

MRVMGIPKNYPRWWIWGILGFWMLMICNGVPVWKEAKTTLFCASDAKAYVKEVHNIWATHACVPTDPSPQELLLKNV
TENFNMWKNDMVDQMHEDIISLWDQSLKPCVKLTPLCVTLICSNATVNQSTTEEMKNCSFNTTTEIRDKEKKEHALF
YRPDIVPLDNETGNTSEYRLINCNTSAVTQACPKVTFEPIPIHYCAPAGYAILKCNDETFNGTGPCSKVSTVQCTHG
IRPVVSTQLLLNGSLAEKGIVVRSENLTNNAKIIIVQLNASVEIVCTRPNNNTRKSVRIGPGQTFYATGDIIGNIRQ
AHCNISEKKWNETLQKVGIELQKHFPNKTIKYNQSAGGDMEITTHSFNCGGEFFYCNTAKLFNSTYNGTYISTNSIN
STLNITLQCRIKQIINMWQGVGRAMYAPPIAGNITCRSNITGLLLTRDGGIHNDSNETETFRPAGGDMRDNWRSELY
KYKVVEVQPLGIAPTGAKERVVEREKE**GIX

>CH0848d1651.10.07D11gp120

MRVMGIPKNYPLWWIWGILGFWMLMNCNGVPVWKEAKTTLFCASDAKAYVKEVHNVWATHACVPTDPSPQELVLDNV
TENFNMWKNDMVDQMHEDIISLWDQSLKPCVKLTPLCVTLNCSNAIVKNSTTEEISHALARNSTTEEMKNCSFNTTT
EIRDKEKKEYALFYRPDIVPLNNKTSNISEYPLINCNTSTVTQACPKVTFEPIPIHYCAPAGYAILKCNDETFNGTG
PCSNVSTVQCTHGIRPVVSTQLLLNGSLAEKGIVIRSENLTNNAKIIIVQLNANASVEIVCTPPNNNTRKSVRIGPG
QTFYATGDIIGNIRQAHCNISEKKWNETLQKVGIELQKHFPNKTIKYNQSAGGDMEITTHSFNCGGEFFYCNTAKLF
NSTYNGTYISTNSINSTLNITLQCRIKQIINMWQGVGRAMYAPPIAGNITCRSNITGLLLTRDGGIHNDSNVTETFR
PAGGDMRDNWRSELYKYKVVEIQPLGIAPTGAKERVVERGKE**GIX

>CH0848d1432.5.26D11gp120

MRVMGILKNYPQWWIWGILGFWMLMNCNGVPVWKEAKTTLFCASDAKAYKKEVHNVWATHACVPTDPSPQELFLKNV
TENFNMWKNDMVDQMHEDIISLWDQSLKPCVKLTPLCVTLICSNAIVKNSTTEEMSNATVKNSTTEEMKNCSFNTTT
EIRDKEKKEYALFYRPDVVPLDETNNTSKYRLINCNTSAVTQACPKVTFEPIPIHYCAPAGYAILKCNDETFNGTGP
CSNVSTVQCTHGIRPVVSTQLLLNGSLAEKEIVIRSENLTNNAKTIIVHLHTPVEIVCTRPYNNTRKSVRIGPGQTF
YATGDIIGDPRQAHCNISKETWNKTLQEVGKELQKHFPNKTIRYNQSAGGDMEITTHSFNCGGEFFYCNTSNLFNST
YNDTYISPNSTNSTSTITLQCRIKQIINMWQGVGRAMYAPPIAGNITCKSNITGLLLTRDGGTTNNSNETETFRPAG
GDMRDNWRSELYKYKVVEVQPLGLAPTGAKERVVEREKE*

Figure 7 DNA sequence of CH848gp140C constructs

>HV1300815_CH848.3.d0078.30.02gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACAAGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGAAGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGCACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGggatcc
>HV1300816_CH848.3.d0078.30.42gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGAACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC

Figure 7 continued

```
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtgaccgaattcgggacccggatcc
>HV1300817_CH848.3.d0107.30.12gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCGCCAACTCCACGAGCAACATCACGCTCCAGTGCCGCATCAAGCAGATCATCAACATGTGGCAGGGGGTGGGCC
GCGCTATGTACGCCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtcaccgaattcgggacccggatcc
>HV1300818_CH848.3.d0107.30.27gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGAAGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACCAACTCCACGAGCAACATCACGCTCCAGTGCCGCATCAAGCAGATCATCAACATGTGGCAGGGGGTGGGCC
GCGCTATGTACGCCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
```

Figure 7 continued

```
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtaaccgaattcgggacccggatcc
>HV1300819_CH848.3.d0107.30.31gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGTCCAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCGCCAACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgttaccgaattcgggacccggatcc
>HV1300820_CH848.3.d0135.27.03gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACCAACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
```

Figure 7 continued

```
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtgaccgaattcgggtcccggatcc
>HV1300821_CH848.3.d0135.27.06gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGGCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAAGTGCAG
CAACGCCATCGTGGACTCCAGCAAGGTGTACGACACGAGGTCCAAGGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGGGATCGTCATCCGGTCCGAGAACCTCACGAACAACGCGAAGATCATCATCGTGCA
GCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTGGCAGTGGAACAAGACCCTGC
ACGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAACACCTCGTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGGACACCAACTGGTCCAACAAGTCGGAGAA
GGACATCTGGGACAACATGACCTGGATGCAGTGGGAGCGCGAGATCTCCAACTACACCGAGACCATCTACAAGCTCCTCGAG
GACTCCCAGCACCAGCAGGAGCGGAACGAGCAGGATCTGCTCGCGCTGGACTCGTGGAACTCCCTGTGGAACTGGTTCAACA
TCACCAACTGGCTGTGGTACATCAAgTAGTgAGgtgaccgaattcaggacccggatcc
>HV1300822_CH848.3.d0135.60.05gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTCGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACCAACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
```

Figure 7 continued

```
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtgaccgaattcaggtcccggatcc
>HV1300823_CH848.3.d0135.60.14gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACCAACTCCACGAGCAACATCACGCTCCAGTGCCGCATCAAGCAGATCATCAACATGTGGCAGGGGGTGGGCC
GCGCTATGTACGCACCGCCCATCGCCGGCCACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtgaccgaattcgggacctggatcc
>HV1300824_CH848.3.d0135.60.19gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACAAGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACCAACTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
```

Figure 7 continued

GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtgaccgaattcgggtcctggatcc
>HV1300825_CH848.3.d0135.60.20gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGAAGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCAACAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtcaccgaattcgggtcccggatcc
>HV1300826_CH848.3.d0135.60.32gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCACCAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG

Figure 7 continued

GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtcaccgaattcaggacccggatcc
>HV1300827_CH848.3.d0135.60.34gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCAACAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtcaccgaattcaggtcccggatcc
>HV1300828_CH848.3.d0194.25.17gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGATCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGTCCG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCTCGACCAACTCGACGAGCAACATCACGCTCCAGTGCCGCATCAAGCAGATCATCAACATGTGGC
AGGGGGTGGGCCGCGCTATGTACGCACCGCCCATCGCCGGCAACATCACCTGCAAGTCCAACATCACCGGCCTCCTGCTGAC
CCGCGACGGCGGCCAAGAACAACAGCAACGAGACGGAGGAGACCTTCAGGCCAGCGGGAGGCGACATGCGCGACAACTGG
CGCTCCGAGCTGTACAAGTACAAGGTGGTGGAGATCCAGCCCCTGGGCATCGCACCCACCGGGGCCAAGgagCGGGTCGTGG
AGCGCGAGAAGgagGCGGCGGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACGCCTCCTGGTCCAA
CAAGTCGGAGAAGGACATCTGGGACAACATGACCTGGATGCAGTGGGAGCGCGAGATCTCCAACTACACCGAGACCATCTAC

Figure 7 continued

```
ATGCTCCTCGAGGACTCCCAGCACCAGCAGGAGCGGAACGAGAAGGATCTGCTCGCGCTGGACTCGTGGAACTCCCTGTGGA
ACTGGTTCAACATCACCAACTGGCTGTGGTACATCCGgTAGTgAGgtcaccgaattcgggacctggatcc
>HV1300829_CH848.3.d0194.25.21gp140C
GgtcgacaagaaGCCACCATGAAGGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGAAGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAGCACGAACTCCACCAGCTCGATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGACGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtcaccgaattcgggtcctggatcc
>HV1300830_CH848.3.d0194.25.24gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTCCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAACACGTCGTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACAACTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
```

Figure 7 continued

```
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCAAgTAGTgAGgtaaccgaattcgggtcccggatcc
>HV1300831_CH848.3.d0194.25.48gp140C
GgtcgacaagaaGCCACCATGCGCGTGATGGGCATCCCGAAGAACTACCCGCAGTGGTGGATCTGGGGCATCCTGGGCTTCT
GGATGCTCATGATCTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCATCGTGGACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTGGCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAACACGTCGTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCCGCgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCATCTGGGGGATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACGTCCTGGTCCAACAAGTCGGAGAA
GGACATCTGGGACAACATGACCTGGATGCAGTGGGAGCGCGAGATCTCCAACTACACCGAGACCATCTACACGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCCGgTAGTgAGgtaaccgaattcaggacccggatcc
>HV1300832_CH848.3.d0274.30.02gp140C
GgtcgacaagaaGCCACCATGCGCGTGATGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGAACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGTGGCAGTGGAACAAGACCCTGC
ACGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAACACGTCGTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACTCGTCCTGGTCCAACAAGTCGGAGAA
GGACATCTGGGACAACATGACCTGGATGCAGTGGGAGCGCGAGATCTCCAACTACACCGAGACCATCTACAAGCTCCTCGAG
```

Figure 7 continued
```
GACTCCCAGCACCAGCAGGAGCGGAACGAGCAGGATCTGCTCGCGCTGGACTCGTGGAACTCCCTGTGGAACTGGTTCAACA
TCACCAACTGGCTGTGGTACATCAAgTAGTgAGgtaaccgaattcaggtcccggatcc
>HV1300833_CH848.3.d0274.30.07gp140C
GgtcgacaagaaGCCACCATGCGCGTGATGGGCATCCCCAAGAACTACCCGCAGTGGTGGATCTGGGGCATCCTGGGCTTCT
GGATACTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAA
CAGCGCCACCGTGGACAACAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACAAGCCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACGACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGGCCAGTGGAACAAGACCCTGC
ACGAGGTGTCCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCAACACGTCGTCCACGAGCAACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACACGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCAAgTAGTgAGgtaaccgaattcgggacctggatcc
>HV1300834_CH848.3.d0274.30.09gp140C
GgtcgacaagaaGCCACCATGCGCGTGTGCGGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGATCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCACCGTGAACTCCAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGTCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCCGGTCCGAGAACCTCACGAACAACGCGAAGATCATCATCGTGCA
CCTGAACACGCCGGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGCCAGTGGAACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCTCGACGAACTCCTCCACCAACTCGACGAGCAACATCACGCTCCAGTGCCGCATCAAGCAGATCATCAACATGTGGC
AGGGGGTGGGCCGCGCTATGTACGCACCGCCCATCGCCGGCAACATCACCTGCAAGTCCAACATCACCGGCCTCCTGCTGAC
CCGCGACGGCGGCACCAAGAACAACAGCAACGAGACGGAGGAGACCTTCAGGCCAGCGGGAGGCGACATGCGCGACAACTGG
CGCTCCGAGCTGTACAAGTACAAGGTGGTGGAGATCCAGCCCCTGGGCATCGCACCCACCGGGGCCAAGgagCGGGTCGTGG
AGCGCGAGAAGgagGCGGCGGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACCACCGCGGTGCCCTGGAACGCGTCCTGGTCCAA
CAAGTCGGAGAAGGACATCTGGGACAACATGACCTGGATGCAGTGGGAGCGCGAGATCTCCAACTACACCGAGACCATCTAC
```

Figure 7 continued

ATGCTCCTCGAGGACTCCCAGCGGCAGCAGGAGCGGAACGAGAAGGATCTGCTCGCGCTGGACTCGTGGAACTCCCTGTGGA
ACTGGTTCAACATCACCAACTGGCTGTGGTACATCCGgTAGTgAGgtaaccgaattcgggtcctggatcc
>HV1300835_CH848.3.d0274.30.14gp140C
GgtcgacaagaaGCCACCATGCGCGTGATGGGCATCCTCAAGAACTACCTGCAGTGGTGGATCTGGGGCATCCTGGGCTTCT
GGATGCTCATGATCTGCAAGggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGAGAACGTGATCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGACCTGCAG
CAACGCCACCGTGGACAACAGCAAGGTGTACGACACGAGGTCCAACGTGAACGTCACGAGCATCAACAACACGATCATGGGC
GAGATGAAGAACTGCTCCTTCAACACGACGACGGAGATCCGCGACAAGGAGAAGAAGGAGTACGCCCTGTTCTACCGGTCGG
ACGTCGTGCCGCTGGACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCGCCGGCTACGCCATCCTGAAGTGCAACAACAAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCCGAGAAGGAGATCGTCATCGGTCCGAGAACCTCACGAACAACGCGAAGATCATCATCGTGCA
CCTGAACACGTCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGCGGCAGTGGTACAAGACCCTGC
AGGAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAACCTGTTCAACGGCACCTACAACGGCACC
TACATCTCGATCAACTCCACGAGCTACATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CACCAAGAACAACAGCAACGAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACCACCGCGGTGCCCTGGAACACCTCCTGGTCCAACAAGTCGGAGAA
GGACATCTGGGACAACATGACCTGGATGCAGTGGGAGCGCGAGATCTCCAACTACACCGAGACCATCTACACGCTCCTCGAG
GACTCCCAGCACCAGCAGGAGCGGAACGAGAAGGATCTGCTCGCGCTGGACTCGTGGAACTCCCTGTGGAACTGGTTCAACA
TCACCAACTGGCTGTGGTACATCAAgTAGTgAGgttaccgaattcgggtcccggatcc
>HV1300836_CH848.3.d0358.80.03gp140C
GgtcgacaagaaGCCACCATGAAGGTGATGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGGGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCAGGTCCAACGTGAACGTCACGAGCATCAACAACACGATCATGGGCGAGATGAAGAACTGCTCCTTCAACACGACG
ACGGAGATCCGCGACAAGGAGAAGAAGGAGTACGCCCTGTTCTACAAGCCCGACGTCGTGCCGCTGAACGAGACCAGCAACA
CCTCGGAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACAACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCCGAGAAGGAGA
TCGTCATCCGGTCCGAGAACCTCACGAACAACGCGAAGATCATCATCGTGCACCTGAACACGCCGGTGGAGATCGTGTGCAC
CCGCCCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGGGCAGTGGAACAAGACCCTGCAGGAGGTGGGCAAGGAGCTGCAGAAGCACT
TCCCCAACAAGACGATTAAGTACGAGCGGTCGGCCGGCGGCGACATGGAGATCACCACGCACTCCTTCAACTGCGGTGGCGA
GTTCTTCTACTGCAACACGTCGAACCTGTTCAACGGCACCTACAACGGCACCTACATCAACATCTCCACCAACTCCAACAGC
ACGATCACGCTCCAGTGCCGCATCAAGCAGATCATCAACATGTGGCAGGGGGTGGGCCGCGCTATGTACGCACCGCCCATCG
CCGGCAACATCACCTGCAAGTCCAACATCACCGGCCTCCTGCTGACCCGCGACGGCGGCACCAAGAACAACAGCAACGAGGA
GACCTTCAGGCCAGCGGGAGGCGACATGCGCGACAACTGGCGTCCGAGCTGTACAAGTACAAGGTGGTGGAGATCCAGCCC
CTGGGCATCGCACCCACCGGGGCCAAGgagCGGGTCGTGGAGCGCGAGAAGgagGCGGCGGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCAT
CGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGA
TCTGCACCACCGCGGTGGCCTGGAACACCTCCTGGTCCAACAAGTCGGAGAAGGACATCTGGGACAACATGACCTGGATGCA
GTGGGAGCGCGAGATCTCCAACTACACCGAGACCATCTACACGCTCCTCGAGGACTCCCAGCGCCAGCAGGAGCGGAACGAG

Figure 7 continued

```
AAGGATCTGCTCGCGCTGGACTCGTGGAACTCCCTGTGGAACTGGTTCAACATCACCAACTGGCTGTGGTACATCAAgTAGT
gAGgttaccgaattcaggacccggatcc
>HV1300837_CH848.3.d0358.80.06gp140C
GgtcgacaagaaGCCACCATGCGGGTGATGGGCATCCCCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCAGGTCCAACGTGAACGTCACGAGCATCAACAACACGATCATGGGCGAGATGAAGAACTGCTCCTTCAACACGACG
ACGGAGATCCGCGACAAGGAGAAGAAGGAGTACGCCCTGTTCTACAAGCCCGACGTCGTGCCGCTGAACGAGACCAGCAACA
CCTCGGAGTACAGGCTGATCAACTGCAACACCTCCGCGGTCACGCAGGCGTGCCCCAAGGTCACGTTCGAGCCCATCCCCAT
CCACTACTGCGCCCCGCCGGCTACGCCATCCTGAAGTGCAACAACAAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCCGAGAAGGAGA
TCGTCATCCGGTCCGAGAACCTCACGAACAACGCGAAGATCATCATCGTGCACCTGAACACGTCGGTGGAGATCGTGTGCAC
CCGCCCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGGGGCAGTGGAACAAGACCCTGCACGAGGTGTCCAAGGAGCTGCAGAAGCACT
TCCCCAACAAGACGATTAAGTACGAGCGGTCGGCCGGCGGCGACATGGAGATCGCCACGCACTCCTTCAACTGCGGTGGCGA
GTTCTTCTACTGCAACACGTCGAACCTGTTCAACGGCACCTACAACGGCACCTACATCAACACGTCCTCCACCAGCTACATC
ACGCTCCAGTGCCGCATCAAGCAGATCATCAACATGTGGCAGGGGGTGGGCCGCGCTATGTACGCACCGCCCATCGCCGGCA
ACATCACCTGCAAGTCCAACATCACCGGCCTCCTGCTGACCCGCGACGGCGGCACCAAGAACAACAGCAACGAGGAGACCTT
CAGGCCAGCGGGAGGCGACATGCGCGACAACTGGCGCTCCGAGCTGTACAAGTACAAGGTGGTGGAGATCCAGCCCCTGGGC
ATCGCACCCACCGGGGCCAAGgagCGGGTCGTGGAGCGCGAGAAGgagGCGGCGGGCCTCGGCGCCCTGTTCCTGGGCTTCC
TGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCA
CCACCACGGTGCCCTGGAACACCTCCTGGTCCAACAAGTCGGAGAAGGACATCTGGGACAACATGACCTGGATGCAGTGGGA
GCGCGAGATCTCCAACTACACCGAGACCATCTACACGCTCCTCGAGGACTCCCAGCGCCAGCAGGAGCGGAACGAGAAGGAT
CTGCTCGCGCTGGACTCGTGGAACTCCCTGTGGAACTGGTTCAACATCACCAACTGGCTGTGGTACATCAAgTAGTgAGgtt
accgaattcaggtcccggatcc
>HV1300838_CH848.3.d0358.80.17gp140C
GgtcgacaagaaGCCACCATGCGGGTGATGGGCATCCTCAAGAACTACCCGCAGTGGTGGATCTGGGGCATCCTGGGCTTCT
GGATGCTCATGAACTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCAGGTCCAACGTGAACGTCACGAGCATCAACAACACGATCATGGGCGAGATGAAGAACTGCTCCTTCAACACGACG
ACGGAGATCCGCGACAAGGAGAAGAAGGAGTACGCCCTGTTCTACCGGCCCGACGTCGTGCCGCTGAACGAGACCAGCAACA
CCTCGGAGTACAGGCTGATCAACTGCAACACCTCCGCGGTCACGCAGGCGTGCCCCAAGGTCACGTTCGAGCCCATCCCCAT
CCACTACTGCGCCCCGCCGGCTACGCCATCCTGAAGTGCAACAACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCCGAGAAGGAGA
TCGTCATCCGGTCCGAGAACCTCACGAACAACGCGAAGATCATCATCGTGCACCTGAACACGTCGGTGGAGATCGTGTGCAC
CCGCCCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGGAGAAGTGGAACAAGACCCTGCAGCAGGTGGGCAAGGAGCTGCAGAAGCACT
TCCCCAACAAGACGATTAAGTACGAGCGGTCGGCCGGCGGCGACATGGAGATCACCACGCACTCCTTCAACTGCGGTGGCGA
GTTCTTCTACTGCAACACGTCGAACCTGTTCAACGGCACCTACAACGGCACCTACATCAACATCTCCACCAACTCCAACAGC
ACGATCACGCTCCAGTGCCGCATCAAGCAGATCATCAACATGTGGCAGGGGGTGGGCCGCGCTATGTACGCACCGCCCATCG
CCGGCAACATCACCTGCAAGTCCAACATCACCGGCCTCCTGCTGACCCGCGACGGCGGCACCAAGAACAACAGCAACGAGGA
GACCTTCAGGCCAGCGGGAGGCGACATGCGCGACAACTGGCGCTCCGAGCTGTACAAGTACAAGGTGGTGGAGATCCAGCCC
CTGGGCATCGCACCCACCGGGGCCAAGgagCGGGTCGTGGAGCGCGAGAAGgagGCGGCGGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCAT
CGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATGTGGGGCTGCTCCGGCAAGCTGA
TCTGCACCACCGCGGTGGCCTGGAACACCTCCTGGTCCAACAAGTCGGAGAAGGACATCTGGGACAACATGACCTGGATGCA
GTGGGAGCGCGAGATCTCCAACTACACCGAGACCATCTACACGCTCCTCGAGGACTCCCAGCGCCAGCAGGAGCGGAACGAG
```

Figure 7 continued

```
AAGGATCTGCTCGCGCTGGACTCGTGGAACTCCCTGTGGAACTGGTTCAACATCACCAACTGGCTGTGGTACATCAAgTAGT
gAGgttaccgaattcgggacctggatcc
>HV1300839_CH848.3.d0358.80.44gp140C
GgtcgacaagaaGCCACCATGCGGGTGATGGGCATCCTCAAGAACTACCCGCGCTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGGGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGCCAGGTCCAACGTGAACGTCACGAGCATCAACAACACGATCATGGGCGAGATGAAGAACTGCTCCTTCAACACGACG
ACGGAGATCCGCGACAAGGAGAAGAAGGAGTACGCCCTGTTCTACAAGCCCGACGTCGTGCCGCTGAACGAGACCAGCAACA
CCTCGGAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACAACAAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCCGAGAAGGAGA
TCGTCATCCGGTCCGAGAACCTCACGAACAACGCGAAGATCATCATCGTGCACCTGAACACGTCGGTGGAGATCGTGTGCAC
CCGCCCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGGAGAAGTGGAACAAGACCCTGCAGGAGGTGGGCAAGGAGCTGCAGAAGCACT
TCCCCAACAAGACGATTAAGTACGAGCGGTCGGCCGGCGGCGACATGGAGATCGCCACGCACTCCTTCAACTGCGGTGGCGA
GTTCTTCTACTGCAACACGTCGAACCTGTTCAACGGCACCTACAACGGCACCGACATCTCCACCAACTCCAACAGCACGATC
ACGCTCCAGTGCCGCATCAAGCAGATCATCAACATGTGGCAGGGGGTGGGCCGCGCTATGTACGCACCGCCCATCGCCGGCA
ACATCACCTGCAAGTCCAACATCACCGGCCTCCTGCTGACCCGCGACGGCGGCACCAAGAACAACAGCAACGAGGAGACCTT
CAGGCCAGCGGGAGGCGACATGCGCGACAACTGGCGCTCCGAGCTGTACAAGTACAAGGTGGTGGAGATCCAGCCCCTGGGC
ATCGCACCCACCGGGGCCAAGgagCGGGTCGTGGAGCGCGAGAAGgagGCGGCGGGCCTCGGCGCCCTGTTCCTGGGCTTCC
TGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCA
CCACCACGGTGCCCTGGAACGCCTCCTGGTCCAACAAGTCGGAGAAGGACATCTGGGACAACATGACCTGGATGCAGTGGGA
GCGCGAGATCTCCAACTACACCGAGACCATCTACATGCTCCTCGAGGACTCCCAGCGCCAGCAGGAGCGGAACGAGAAGGAT
CTGCTCGCGCTGGACTCGTGGAACTCCCTGTGGAACTGGTTCAACATCACCAACTGGCTGTGGTACATCAAgTAGTgAGgtt
accgaattcgggtcctggatcc
>HV1300840_CH848.3.d0445.25.04gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGGCAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGTCAACGTGGTGAACGTCACGAACATCACGAACACGATCAAGGGCGAGATGAAGAACTGCTCCTTCAACACGACGACG
GAGATCCGCGACAAGGAGAAGAAGGAGTACGCCCTGTTCTACCGGCCCGACGTCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGGGATCG
TCATCCGGTCCGAGAACCTCACGAACAACGCGAAGATCATCATCGTGCAGCTGAACACGTCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCACGAGGTGTCGAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAAGCTGTTCAACGGCACCTACAACGGCACCTACATCTCCACCAACTCCACCAGCTACATCACG
CTCCAGTGCCGCATCAAGCAGATCATCAACATGTGGCAGGGGGTGGGCCGCGCTATGTACGCACCGCCCATCGCCGGCAACA
TCACCTGCAAGTCCAACATCACCGGCCTCCTGCTGACCCGCGACGGCGGCACCAACAACAACAGCAACGAGGAGACCTTCAG
GCCAGCGGGAGGCGACATGCGCGACAACTGGCGCTCCGAGCTGTACAAGTACAAGGTGGTGGAGATCCAGCCCCTGGGCATC
GCACCCACCGGGGCCAAGgagCGGGTCGTGGAGCGCGAGAAGgagGCGGCGGGCCTCGGCGCCCTGTTCCTGGGCTTCCTGG
GCGCTGCGGGCTCCACCATGGGTGCCGCGTCCATCACCCTGACCGTGCAGGCCCGCCAGCTGCTCTCCGGCATCGTGCAGCA
GCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGCACCA
CCGCCGTGGCGTGGAACACCTCCTGGTCCAACAAGTCGGAGAAGGACATCTGGGACAACATGACCTGGATGCAGTGGGAGCG
CGAGATCTCCAACTACACCGAGACCATCTACACCCTCCTCGAGGACTCCCAGCGCCAGCAGGAGCGGAACGAGAAGGATCTG
```

Figure 7 continued

CTCGCGCTGGACTCGTGGAACTCCCTGTGGAACTGGTTCAACATCACCAACTGGCTGTGGTACATCAAgTAGTgAGggaccc
gaattcggtgaccggatcc
>HV1300841_CH848.3.d0445.25.18gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCAG
CAACGTCAACGTGGTGAACGTCACGAACATCACGAACACGATCAAGGGCGAGATGAAGAACTGCTCCTTCAACACGACGACG
GAGATCCGCGACAAGGAGAAGAAGGAGTACGCCCTGTTCTACCGGCCCGACGTCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGCACACGCCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCAGGAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAACCTGTTCAACGGCACCTACAACGGCCCGTACATCAACATCTCCACCAACTCCAACAGCACC
ATCACGCTCCAGTGCCGCATCAAGCAGATCATCAACATGTGGCAGGGGGTGGGCCGCGCTATGTACGCACCGCCCATCGCCG
GCAACATCACCTGCAAGTCCAACATCACCGGCCTCCTGCTGACCCGCGACGGCGGCACCAAGAACAACAGCAACGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagGCGGCGGGCCTCGGCGCCCTGTTCCTGGGCT
TCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAGGGCCATCGAGGCCCAGCAGCACATGCTGCAGCTGACCGTGTGGGGCATCAAGCAGCTG
CAGGCCAGGGTGCTCGCGCTCGAGCGCTACCTGAAGGACCAGCAGCTGCTCGGCATGTGGGGCTGCTCCGGCAAGCTGATCT
GCACCACCGCCGTGGCGTGGAACACCTCCTGGTCCAACAAGTCGGAGAAGGACATCTGGGACAACATGACCTGGATGCAGTG
GGAGCGCGAGATCTCCAACTACACCGAGACCATCTACACCCTCCTCGAGGACTCCCAGCGCCAGCAGGAGCGGAACGAGAAG
GATCTGCTCGCGCTGGACTCGTGGAACTCCCTGTGGAACTGGTTCAACATCACCAACTGGCTGTGGTACATCAAgTAGTgAG
ggacccgaattcggtcaccggatcc
>HV1300842_CH848.3.d0445.25.26gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGGACTGCTC
GAACGTGAACGTCGTGAACGTCACGAACATCACCAACACGATCAAGGGCGAGATGAAGAACTGCTCCTTCAACACGACGACG
GAGATCCGCGACAAGGAGAAGAAGGAGTACGCCCTGTTCTACCGGCCCGACGTCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCCGAGAAGGAGATCG
TCATCCGGTCCGAGAACCTCACGAACAACGCGAAGATCATCATCGTGCACCTGAACACGCCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGAAGCAGTGGAACGAGACCCTGCAGAAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAACCTGTTCAACGGCACCTACAACGGCACCTACATCAACATCTCCACCAACTCCAACAGCACG
ATCACGCTCCAGTGCCGCATCAAGCAGATCATCAACATGTGGCAGGGGGTGGGCCGCGCTATGTACGCACCGCCCATCGCCG
GCAACATCACCTGCCGGTCCAACATCACCGGCCTCCTGCTGACCCGCGACGGCGGCACCAAGAACAACAGCAACGAGGAGAC
CTTCAGGCCAGCGGGAGGCGACATGCGCGACAACTGGCGCTCCGAGCTGTACAAGTACAAGGTGGTGGAGATCCAGCCCCTG
GGCATCGCACCCACCGGGGCCAAGgagCGGGTCGTGGAGCGCGAGAAGgagGCGGCGGGCCTCGGCGCCCTGTTCCTGGGCT
TCCTGGGCGCTGCGGGCTCCACCATGGGTGCCGCGTCCATCACCCTGACCGTGCAGGCCCGCCAGCTGCTCTCCGGCATCGT
GCAGCAGCAGTCCAACCTCCTGAGGGCCATCGAGGCCCAGCAGCACATGCTGCAGCTGACCGTGTGGGGCATCAAGCAGCTG
CAGGCCAGGGTGCTCGCGCTCGAGCGCTACCTGAAGGACCAGCAGCTGCTCGGCATGTGGGGCTGCTCCGGCAAGCTGATCT
GCACCACCGCCGGTGCCGTGGAACTCCTCCTGGTCCAACAAGTCGGAGAAGGACATCTGGGACAACATGACCTGGATGCAGTG
GGAGCGCGAGATCTCCAACTACACCGAGACCATCTACACGCTCCTCGAGGACTCCCAGCGCCAGCAGGAGCGGAACGAGAAG

Figure 7 continued

GATCTGCTCGCGCTGGACTCGTGGAACTCCCTGTGGAACTGGTTCAACATCACCAAGTGGCTGTGGTACATCAAgTAGTgAG
ggacccgaattcggtaaccggatcc
>HV1300843_CH848.3.d0445.30.41gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAAGggcAAGGGCAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGATGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGTGTCCAACGTGAACGTCACGAACATCACGAACACGATCAAGGGCGAGATGAAGAACTGCTCCTTCAACACGACGACG
GAGATCCGCGACAAGGAGAAGAAGGAGTACGCCCTGTTCTACCGGCCCGACGTCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGAACACGTCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCAGCAGGTGGGCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACTCCACCAACTCCACCAGCACGATCACGCTC
CAGTGCCGCATCAAGCAGATCATCAACATGTGGCAGGGGGTGGGCCGCGCTATGTACGCACCGCCCATCGCCGGCAACATCA
CCTGCAAGTCCAACATCACCGGCCTCCTGCTGACCCGCGACGGCGGCACCAAGAACAACAGCAACGAGGAGACCTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCAACACCG
CGGTGGCCTGGAACACGTCCTGGTCCAACAAGTCGGAGAAGGACATCTGGGACAACATGACCTGGATGCAGTGGGAGCGCGA
GATCTCCAACTACACCGAGACCATCTACACGCTCCTCGAGGACTCCCAGCGCCAGCAGGAGCGGAACGAGAAGGATCTGCTC
GCGCTGGACTCGTGGAACTCCCTGTGGAACTGGTTCAACATCACCAACTGGCTGTGGTACATCAAgTAGTgAGggacccgaa
ttcggttaccggatcc
>HV1300844_CH848.3.d0445.30.42gp140C
GgtcgacaagaaGCCACCATGCGGGTGATGGGCATCCTCAAGAACTACCCGCCGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCCGGGCCTACGAGAAGGAGGTGCACAACGTGTGGGCGACCCACGCCTGCGTGCCCACG
GACCCCAGCCCGCAGGAGCTCGTCCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGTGAACGTGGTGAACGTCACGAACATCACGAACACGATCAAGGGCGAGATGAAGAACTGCTCCTTCAACACGACGACG
GAGATCCGCGACAAGGAGAAGAAGGAGTACGCCCTGTTCTACAAGCCCGACGTCGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGAACACGTCGGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCACGAGGTGTCCAAGGAGCTGCAGAAGCACTTCC
CCAACAAGACGATTAAGTACGAGCGGTCGGCCGGCGGCGACATGGAGATCGCCACGCACTCCTTCAACTGCGGTGGCGAGTT
CTTCTACTGCAACACGTCGAACCTGTTCAACGGCACCTACAACGGCACCTACATCTCGACCAACTCGTCCGCGAACTCCAAC
AGCACGATCACGCTCCAGTGCCGCATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCACCAAGAACAACAGCAACGA
GGAGACCTTCAGGCCAGCGGGAGGCGACATGCGCGACAACTGGCGCTCCGAGCTGTACAAGTACAAGGTGGTGGAGATCCAG
CCCCTGGGCATCGCACCCACCGGGGCCAAGgagCGGGTCGTGGAGCGCGAGAAGgagGCGGCGGGCCTCGGCGCCCTGTTCC
TGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGC
TGATCTGCACGACCGCGGTGGCCTGGAACACGTCCTGGTCCAACAAGTCGGAGAAGGACATCTGGGACAACATGACCTGGAT
GCAGTGGGAGCGCGAGATCTCCAACTACACCGAGACCATCTACACGCTCCTCGAGGACTCCCAGCGCCAGCAGGAGCGGAAC

Figure 7 continued

```
GAGAAGGATCTGCTCGCGCTGGACTCGTGGAACTCCCTGTGGAACTGGTTCAACATCACCAACTGGCTGTGGTACATCAAgT
AGTgAGggtcccgaattcggtgaccggatcc
>HV1300845_CH848.3.d0526.25.02gp140C
GgtcgacaagaaGCCACCATGAAGGTGATGGGCATCCTCAAGAACTACCCGCAGTGGTGGATCTGGGGCATCCTGGGCTTCT
GGATGCTCATGATCTGCAAGggcAAGGGCAACCTCTGGGTGACGGTGTACTACGGCgtgCCGGTGTGGAAGGAGGCCAAGAC
GACCCTGTTCTGCGCGTCGGACGCCCGCGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGCCTACGACACGCGCTCCAACGTGAACGTCACGTCCATCAACAACACGATCATGGGC
GAGATGAAGAACTGCTCCTTCAACACGACGACGGAGATCCGCGACAAGGAGAAGAAGGAGTACGCCCTGTTCTACAAGCCCG
ACATCGTGCCGCTGAACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCA
CCTGAACACGTCGGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGAAGCAGTGGAACGAGACCCTGC
AGAAGGTGGGCAAGGAGCTGCAGAAGCACTTCCCCAACAAGACGATTAAGTACGAGCGGTCGGCCGGCGGCGACATGGAGAT
CGCCACGCACTCCTTCAACTGCGGTGGCGAGTTCTTCTACTGCAACACGTCGAAGCTGTTCAACGGCACCTACAACGGCACC
GACATCAACATCTCCACGAACTCCAACAGCACGATCACGCTCCAGTGCCGCATCAAGCAGATCATCAACATGTGGCAGGGGG
TGGGCCGCGCTATGTACGCACCGCCCATCGCCGGCAACATCACCTGCAAGTCCAACATCACCGGCCTCCTGCTGACCCGCGA
CGGCGGCACCAACTCCAACAAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACGACCAACGTGCCCTGGAACACGTCCTGGTCCAACAAGTCGGAGAA
GGACATCTGGGACAACATGACCTGGATGCAGTGGGAGCGCGAGATCTCCAACTACACCGAGACCATCTACATGCTCCTCGAG
GACTCCCAGCGCCAGCAGGAGCGGAACGAGAAGGATCTGCTCGCGCTGGACTCGTGGAACTCCCTGTGGAACTGGTTCAACA
TCACCAACTGGCTGTGGTACATCAAgTAGTgAGaggacccgaattcggtgaccggatcc
>HV1300846_CH848.3.d0526.25.09gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCCGCGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGTCAACGTGACCGGGTCCAACGTGAACGTCACGAACATCACGAACACGATCACCGGCGAGATGAAGAACTGCTCCTTC
AACACGACGACGGAGATCCGCGACAAGGAGAAGAAGGAGTACGCCCTGTTCTACAAGCCCGACGTGGTGCCGCTGAACGAGA
CCAGCAACACCTCGGAGTACAGGCTGATCAACTGCAACACCTCCGCGGTCACGCAGGCGTGCCCCAAGGTCACGTTCGAGCC
CATCCCCATCCACTACTGCGCCCCGCCGGCTACGCCATCCTGAAGTGCAACAACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTGGCGG
AGAAGGGGATCGTCATCCGGTCCGAGAACCTCACGAACAACGCGAAGATCATCATCGTGCAGCTGAACACGTCGGTGGAGAT
CGTGTGCACCCGCCCGGGCAACAACACGCGCAAGTCCGTCCGGATCGGCCCTGGCCAGACCTTCTACGCCACCGGCGGCATC
ATCGGCGACATCCGCCAGGCCCACTGCAACATCAGCGAGTCGAAGTGGAACGAGACCCTGCACGAGGTGTCCAAGGAGCTGC
AGAAGCACTTCCCCAACAAGACGATTAAGTACGAGCGGTCGGCCGGCGGCGACATGGAGATCACCACGCACTCCTTCAACTG
CGGTGGCGAGTTCTTCTACTGCAACACGTCGAACCTGTTCAACGGCACCTACAACGGCACCTACAACGGGACGAACTCCAAC
AGCACGATCACGCTCCAGTGCCGCATCAAGCAGATCATCAACATGTGGCAGGGGGTGGGCCGCGCTATGTACGCACCGCCCA
TCGCCGGCAACATCACCTGCCGGTCCAACATCACCGGCCTCCTGCTGACCCGCGACGGCGGCACCAACTCCAACAAGACGGA
GGAGACCTTCAGGCCAGCGGGAGGCGACATGCGCGACAACTGGCGCTCCGAGCTGTACAAGTACAAGGTGGTGGAGATCCAG
CCCCTGGGCATCGCACCCACCGGGGCCAAGgagCGGGTCGTGGAGCGCGAGAAGgagGCGGCGGGCCTCGGCGCCCTGTTCC
TGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGC
TGATCTGCACGACCAACGTGCCCTGGAACACGTCCTGGTCCAACAAGTCGGAGAAGGACATCTGGGACAACATGACCTGGAT
GCAGTGGGAGCGCGAGATCTCCAACTACACCGAGACCATCTACACGCTCCTCGAGGACTCCCAGCGCCAGCAGGAGCGGAAC
```

Figure 7 continued

```
GAGAAGGATCTGCTCGCGCTGGACTCGTGGAACTCCCTGTGGAACTGGTTCAACATCACCAACTGGCTGTGGTACATCAAgT
AGTgAGaggtcccgaattcggtgaccggatcc
>HV1300847_CH848.3.d0526.25.10gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACGgcAAGGGCAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGTCAACGTGGTGAACGTCACGAACATCACGAACACGATCAAGGGCGAGATGAAGAACTGCTCCTTCAACACGACGACG
GAGATCCGCGACAAGGAGAAGAAGGAGTACGCCCTGTTCTACCGCCCCGACGTGGTGCCGCTGAACGAGACCAGCAACACCT
CGGAGTACAGGCTGATCAACTGCAACACCTCCGCGGTCACGCAGGCGTGCCCCAAGGTCACGTTCGAGCCCATCCCCATCCA
CTACTGCGCCCCCGCCGGCTACGCCATCCTGAAGTGCAACAACGAGACCTTCAACGGGACCGGCCCGTGCAGCAACGTGTCC
ACCGTGCAGTGCACGCACGGCATCCGGCCCGTGGTGTCCACGCAGCTGCTCCTGAACGGGTCGCTGGCGGAGAAGGAGATCG
TCATCCGGTCCGAGAACCTCACGAACAACGCGAAGATCATCATCGTGCACCTGCACACGCCCGTGGAGATCGTGTGCACCCG
CCCGGGCAACAACACGCGCAAGTCCGTCCGGATCGGCCCTGGCCAGACCTTCTACGCCACCGGCGACATCATCGGCGACATC
CGCCAGGCCCACTGCAACATCAGCGAGGAGAAGTGGAACAAGACCCTGCAGCAGGTGGGCAAGGAGCTGCAGAAGCACTTCC
CCAACAAGACGATTAAGTACGAGCGGTCGGCCGGCGGCGACATGGAGATCACCACGCACTCCTTCAACTGCGGTGGCGAGTT
CTTCTACTGCAACACGTCGAACCTGTTCAACGGCACCTACAACGGCAAGTACATCAACATCTCCACGAACTCCAACAGCACG
ATCACGCTCCAGTGCCGCATCAAGCAGATCATCAACATGTGGCAGGGGGTGGGCCGCGCTATGTACGCACCGCCCATCGCCG
GCAACATCACCTGCAAGTCCAACATCACCGGCCTCTGCTGACCCGCGACGGCGGCACCAAGAACAACTCGACGGAGACGGA
GGAGACCTTCAGGCCAGCGGGAGGCGACATGCGCGACAACTGGCGCTCCGAGCTGTACAAGTACAAGGTGGTGGAGATCCAG
CCCCTGGGCATCGCACCCACCGGGGCCAAGgagCGGGTCGTGGAGCGCGAGAAGgagGCGGCGGGCCTCGGCGCCCTGTTCC
TGGGCTTCCTGGGCGCTGCGGGCTCCACCATGGGTGCCGCGTCCATCACCCTGACCGTGCAGGCCCGCCAGCTGCTCTCCGG
CATCGTGCAGCAGCAGTCCAACCTCCTGAGGGCCATCGAGGCCCAGCAGCACATGCTGCAGCTGACCGTGTGGGGCATCAAG
CAGCTGCAGGCCAGGGTGCTCGCGCTCGAGCGCTACCTGAAGGACCAGCAGCTGCTCGGCATGTGGGGCTGCTCCGGCAAGC
TGATCTGCACGACCGACGTGCCCTGGAACACGTCCTGGTCCAACAAGTCGGAGAAGGACATCTGGGACAACATGACCTGGAT
GCAGTGGGAGCGCGAGATCTCCAACTACACCGAGACCATCTACACGCTCCTCGAGGACTCCCAGCGCCAGCAGGAGCGGAAC
GAGAAGGATCTGCTCGCGCTGGACTCGTGGAACTCCCTGTGGAACTGGTTCAACATCACCAACTGGCTGTGGTACATCAAgT
AGTgAGggacctgaattcggtgaccggatcc
>HV1300848_CH848.3.d0526.25.11gp140C
GgtcgacaagaaGCCACCATGCGGGTGATGGGCATCCTCAAGAACTGCCCGCAGTGGTGGATCTGGGGCATCCTGGGCTTCT
GGATGCTCATGATCTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGACACGCGCTCGAACGTGTCCGTCACGTCCATCAACAACACGATCATGGGC
GAGATGAAGAACTGCTCCTTCAACACGACGACGGAGATCCGCGACAAGGAGAAGAAGGAGTACGCCCTGTTCTACCGCCCCG
ACATCGTGCCGCTGAACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCA
CCTGAACACGCCCGTGGAGATCGTGTGCACCCGCCCGTCCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGAGAAGTGGAACAAGACCCTGC
AGAAGGTGGGCAAGGAGCTGCAGAAGCACTTCCCCAACAAGACGATTAAGTACGAGCGGTCGGCCGGCGGCGACATGGAGAT
CACCACGCACTCCTTCAACTGCGGTGGCGAGTTCTTCTACTGCAACACGTCGAACCTGTTCAACGGCACCTACAACGGCACG
TACACCAACATCTCCACGAACTCCAACAGCACGATCACGCTCCAGTGCCGCATCAAGCAGATCATCAACATGTGGCAGGGGG
TGGGCCGCGCTATGTACGCACCGCCCATCGCCGGCAACATCACCTGCCGGTCCAACATCACCGGCCTCCTGCTGACCCGCGA
CGGCGGCACCAACTCGAACAAGACGGAGGAGACCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACGACCAACGTGCCCTGGAACACGTCCTGGTCCAACAAGTCGGAGAA
GGACATCTGGGACAACATGACCTGGATGCAGTGGGAGCGCGAGATCTCCAACTACACCGAGACCATCTACACGCTCCTCGAG
```

Figure 7 continued

GACTCCCAGCGCCAGCAGGAGCGGAACGAGAAGGATCTGCTCGCGCTGGACTCGTGGAACTCCCTGTGGAACTGGTTCAACA
TCACCAACTGGCTGTGGTACATCAAgTAGTgAGggtcctgaattcggtgaccggatcc
>HV1300849_CH848.3.d0526.25.21gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTGCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCGT
GAACGTCACGAACATCACGAACACGATCAAGGGCGAGATGAAGAACTGCTCCTTCAACACGACGACGGAGATCCGCGACAAG
GAGAAGAAGGAGTACGCCCTGTTCTACCGCCCCGACGTCGTGCCGCTGAACGAGACCAGCAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACAACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGGGATCGTCATCCGGTCCGAGA
ACCTCACGAACAACGCGAAGATCATCATCGTGCAGCTGAACACGTCGGTGGAGATCGTGTGCACCCGCCCGGGGAACAACAC
GCGCAAGTCCGTCCGGATCGGCCCTGGCCAGACCTTCTACGCCACCGGCGACATCATCGGCGACATCCGCCAGGCCCACTGC
AACATCAGCGAGGAGAAGTGGAACAAGACCCTGCAGCAGGTGGGCAAGGAGCTGCAGAAGCACTTCCCCAACAAGACGATTA
AGTACGAGCGGTCGGCCGGCGGCGACATGGAGATCACCACGCACTCCTTCAACTGCGGTGGCGAGTTCTTCTACTGCAACAC
GTCGAACCTGTTCAACGGCACCTACAACGGCACGTACAACGGCTCCACGAACTCCAACAGCACGATCACGCTCCAGTGCCGC
ATCAAGCAGATCATCAACATGTGGCAGGGGGTGGGCCGCGCTATGTACGCACCGCCCATCGCCGGCAACATCACCTGCCGGT
CCAACATCACCGGCCTCCTGCTGACCCGCGACGGCGGCACCAACTCGAACAAGACGGAGGAGACCTTCAGGCCAGCGGGAGG
CGACATGCGCGACAACTGGCGCTCCGAGCTGTACAAGTACAAGGTGGTGGAGATCCAGCCCCTGGGCATCGCACCCACCGGG
GCCAAGgagCGGGTCGTGGAGCGCGAGAAGgagGCGGCGGGCCTCGGCGCCCTGTTCCTGGGCTTCCTGGGCGCTGCGGGCT
CCACCATGGGTGCCGCGTCCATCACCCTGACCGTGCAGGCCCGCCAGCTGCTCTCCGGCATCGTGCAGCAGCAGTCCAACCT
CCTGAGGGCCATCGAGGCCCAGCAGCACATGCTGCAGCTGACCGTGTGGGGCATCAAGCAGCTGCAGGCCAGGGTGCTCGCG
CTCGAGCGCTACCTGAAGGACCAGCAGCTGCTCGGCATGTGGGGCTGCTCCGGCAAGCTGATCTGCACGACCAACGTGCCCT
GGAACACGTCCTGGTCCAACAAGTCGGAGAAGGACATCTGGGACAACATGACCTGGATGCAGTGGGAGCGCGAGATCTCCAA
CTACACCGAGACCATCTACACGCTCCTCGAGGACTCCCAGCGCCAGCAGGAGCGGAACGAGAAGGATCTGCTCGCGCTGGAC
TCGTGGAACTCCCTGTGGAACTGGTTCAACATCACCAACTGGCTGTGGTACATCAAgTAGTgAGggtcccgaattcggtcac
cggatcc
>HV1300850_CH848.3.d0526.25.32gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCCGCGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGACACGCGCTCCAACGCGAACGTCACGTCCATCAACAACACGATCATGGGC
GAGATGAAGAACTGCTCCTTCAACACGACGACGGAGATCCGCGACAAGGAGAAGAAGGAGTACGCCCTGTTCTACCGGCCCG
ACATCGTGCCGCTGAACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCA
CCTGCACACGCCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGAGAAGTGGAACAAGACCCTGC
AGAAGGTGGGCAAGGAGCTGCAGAAGCACTTCCCCAACAAGACGATTAAGTACGAGCGGTCGGCCGGCGGCGACATGGAGAT
CACCACGCACTCCTTCAACTGCGGTGGCGAGTTCTTCTACTGCAACACGTCGAACCTGTTCAACGGCACCTACAACGGCACC
TACAACGGGACCAACTCGAACAGCACGATCACGCTCCAGTGCCGCATCAAGCAGATCATCAACATGTGGCAGGGGGTGGGCC
GCGCTATGTACGCACCGCCCATCGCCGGCAACATCACCTGCCGGTCCAACATCACCGGCCTCCTGCTGACCCGCGACGGCGG
CACCAACTCCAACAAGACGGAGGAGACCTTCAGGCCAGCGGGAGGCGACATGCGCGACAACTGGCGCTCCGAGCTGTACAAG
TACAAGGTGGTGGAGATCCAGCCCCTGGGCATCGCACCCACCGGGCCCAAGgagCGGGTCGTGGAGCGCGAGAAGgagGCGG
CGGGCCTCGGCGCCCTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACGACCACGGTGGCGTGGAACACGTCCTGGTCCAACAAGTCGGAGAAGGACAT
CTGGGACAACATGACCTGGATGCAGTGGGAGCGCGAGATCTCCAACTACACCGAGACCATCTACACCCTCCTCGAGGACTCC

Figure 7 continued

CAGCGCCAGCAGGAGCGGAACGAGAAGGATCTGCTCGCGCTGGACTCGTGGAACTCCCTGTGGAACTGGTTCAACATCACCA
ACTGGCTGTGGTACATCAAgTAGTgAGaggacccgaattcggtcaccggatcc
>HV1300851_CH848.3.d0526.25.39gp140C
GgtcgacaagaaGCCACCATGCGGGTGATGGGCATCCCCAAGAACTACCCGCAGTGGTGGATCTGGGGCATCCTGGGCTTCT
GGATGCTCATGATCTGCTCGggcCGCGGGAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGATGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGACACGCGCTCCAACGTGAACGTCACGTCCATCAACAACACGATCATGGGC
GAGATGAAGAACTGCTCCTTCAACACGACGACGGAGATCCGCGACAAGGAGAAGAAGGAGTACGCCCTGTTCTACAAGCCCG
ACATCGTGCCGCTGAACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCGCCGGCTACGCCATCCTGAAGTGCAACAACGAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCA
CCTGAACACGCCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGAGAAGTGGAACAAGACCCTGC
AGAAGGTGGGCAAGGAGCTGCAGAAGCACTTCCCCAACAAGACGATTAAGTACGAGCGGTCGGCCGGCGGCGACATGGAGAT
CACCACGCACTCCTTCAACTGCGGTGGCGAGTTCTTCTACTGCAACACGTCGAAGCTGTTCAACGGCACCTACAACGGGATC
AACATCTCGACCAACCTCGAACAGCACGATCACGCTCCAGTGCCGCATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CAACCGGAACAACAGCAACGAGGAGACCTTCAGGCCAGCGGGAGGCGACATGCGCGACAACTGGCGCTCCGAGCTGTACAAG
TACAAGGTGGTGGAGATCCAGCCCCTGGGCATCGCACCCACCGGGGCCAAGgagCGGGTCGTGGAGCGCGAGAAGgagGCGG
CGGGCCTCGGCGCCCTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTCGGCA
TGTGGGGCTGCTCCGGCAAGCTGATCTGCACGACCAACGTGCCCTGGAACACGTCCTGGTCCAACAAGTCGGAGAAGGACAT
CTGGGACAACATGACCTGGATGCAGTGGGAGCGCGAGATCTCCAACTACACCGAGACCATCTACATGCTCCTCGAGGACTCC
CAGCGCCAGCAGGAGCGGAACGAGAAGGATCTGCTCGCGCTGGACTCGTGGAACTCCCTGTGGAACTGGTTCAACATCACCA
ACTGGCTGTGGTACATCAAgTAGTgAGaggtcccgaattcggtcaccggatcc
>HV1300852_CH848.3.d0611.9.02gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGAGATGAAGAACTGCTCCTTCAACACGACGACGGAGATCCGCGACAAGGAG
AAGAAGGAGTACGCCCTGTTCTACCGGCCCGACATCGTGCCGCTGGGCGAGACCAGCAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACAACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGGGATCGTCATCCGGTCCGAGAACC
TCACGAACAACGCGAAGATCATCATCGTGCACCTGCACACGCCCGTGGAGATCGTGTGCACCCGCCCGGGCAACAACACGCG
CAAGTCCGTCCGGATCGGCCCTGGCCAGACCTTCTACGCCACCGGCGACATCATCGGCGACATCCGCCAGGCCCACTGCAAC
ATCAGCGAGGAGAAGTGGAACAAGACCCTGCAGAAGGTGGGCAAGGAGCTGCAGAAGCACTTCCCCAACAAGACGATTAAGT
ACGCCCAGTCGGCCGGCGGCGACATGGAGATCACCACGCACTCCTTCAACTGCGGTGGCGAGTTCTTCTACTGCAACACGTC
GAAGCTGTTCAACGGGACGTACAACGGCGCCTACATCAACATCTCGACCAACTCGAACAGCACGATCACGCTCCAGTGCCGC
ATCAAGCAGATCATCAACATGTGGCAGGGGGTGGGCCGCGCTATGTACGCACCGCCCATCGCCGGCAACATCACCTGCAAGT
CCAACATCACCGGCCTCCTGCTGACCCGCGACGGCGGCACGAACAACAAGACGGAGGAGATCTTCAGGCCAGCGGGAGGCGA
CATGCGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagCGGCGGGCCTCGGCGCCCTGTTCCTGGGCTTCCTGGGCGCTGCGGGCTCCA
CCATGGGTGCCGCGTCCATCACCCTGACCGTGCAGGCCCGCCAGCTGCTCTCCGGCATCGTGCAGCAGCAGTCCAACCTCCT
GAGGGCCATCGAGGCCCAGCAGCACATGCTGCAGCTGACCGTGTGGGGCATCAAGCAGCTGCAGGCCAGGGTGCTCGCGCTC
GAGCGCTACCTGAAGGACCAGCAGCTGCTCGGCATGTGGGGCTGCTCCGGCAAGCTGATCTGCACGACCGTCGTGCCCTGGA
ACACGTCCTGGTCCAACAAGTCGGAGAAGGACATCTGGGACAACATGACCTGGATGCAGTGGGAGCGCGAGATCTCCAACTA
CACCGAGACCATCTACAAGCTCCTCGAGGACTCCCAGAACCAGCAGGAGCGGAACGAGCAGGATCTGCTCGCGCTGGACTCG

Figure 7 continued

TGGAACTCCCTGTGGAACTGGTTCAACATCACCAAGTGGCTGTGGTACATCAAgTAGTgAGggacctgaattcggtcaccgg
atcc
>HV1300853_CH848.3.d0611.20.12gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGGGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCATGGGCGAGATGAAGAACTGCTCCTTCAACACGACGACGGAGATCCGCGACAAGGAG
AAGAAGGAGTACGCCCTGTTCTACAAGCCCGACGTCGTGCCGCTGGACGAGACCAACAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACAACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTGATCCGGTCCGAGAACC
TCACGAACAACGCGAAGATCATCATCGTGCACCTGAACACGCCCGTGGAGATCGTGTGCACCCGCCCGGGCAACAACACGCG
CAAGTCCGTCCGGATCGGCCCTGGCCAGACCTTCTACGCCACCGGCGCGATCATCGGCGACATCCGCCAGGCCCACTGCAAC
ATCAGCGAGTCCAAGTGGAACGAGACCCTGCAGAAGGTGGGCAAGGAGCTGCAGAAGCACTTCCCCAACAAGACGATTAAGT
ACGAGCAGTCGGCCGGCGGCGACATGGAGATCACCACGCACTCCTTCAACTGCGGTGGCGAGTTCTTCTACTGCAACACGTC
GAAGCTGTTCAACGGGACGTACAACGGCGCCTACATCAACATCTCGACCAACTCGAACAGCACGATCACGCTCCAGTGCCGC
ATCAAGCAGATCATCAACATGTGGCAGGGGGTGGGCCGCGCTATGTACGCACCGCCCATCGCCGGCAACATCACCTGCAAGT
CCAACATCACCGGCCTCCTGCTGACCCGCGACGGCGGCACGAACAACAAGACGGAGGAGATCTTCAGGCCAGCGGGAGGCGA
CATGCGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGCTCCA
CCATGGGTGCCGCGTCCATCACCCTGACCGTGCAGGCCCGCCAGCTGCTCTCCGGCATCGTGCAGCAGCAGTCCAACCTCCT
GAGGGCCATCGAGGCCCAGCAGCACATGCTGCAGCTGACCGTGTGGGGCATCAAGCAGCTGCAGGCCAGGGTGCTCGCGCTC
GAGCGCTACCTGAAGGACCAGCAGCTGCTCGGCATGTGGGGCTGCTCCGGCAAGCTGATCTGCACGACCAACGTGCCCTGGA
ACACGTCCTGGTCCAACAAGTCGGAGAAGGACATCTGGGACAACATGACCTGGATGCAGTGGGAGCGCGAGATCTCCAACTA
CACCGAGACCATCTACATGCTCCTCGAGGACTCCCAGCGGCAGCAGGAGCGGAACGAGAAGGATCTGCTCGCGCTGGACTCG
TGGAACTCCCTGTGGAACTGGTTCAACATCACCAACTGGCTGTGGTACATCAAgTAGTgAGggtcctgaattcggtcaccgg
atcc
>HV1300854_CH848.3.d0611.20.14gp140C
GgtcgacaagaaGCCACCATGAAGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTCCTGGGGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGAGATGAAGAACTGCTCCTTCAACACGACGACGGAGATCCGCGACAAGGAG
AAGAAGGAGTACGCCCTGTTCTACCGGCCCGACATCGTGCCGCTGAACGAGACCAGCAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACAACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGCACACGCCCGTGGAGATCGTGTGCACCCGCCCGGGCAACAACACGCG
CAAGTCCGTCCGGATCGGCCCTGGCCAGACCTTCTACGCCACCGGCGACATCATCGGCGACATCCGCCAGGCCCACTGCAAC
ATCAGCGAGAAGCAGTGGAACGAGACCCTGCAGAAGGTGGGCAAGGAGCTGCAGAAGCACTTCCCCAACAAGACGATTAAGT
ACGAGAGGTCGGCCGGCGGCGACATGGAGATCACCACGCACTCCTTCAACTCGTCCGCGAACTCGAACAGCACGATCACGCTCCAG
TGCCGCATCAAGCAGATCATCAACATGTGGCAGGGGGTGGGCCGCGCTATGTACGCACCGCCCATCGCCGGCAACATCACCT
GCAAGTCCAACATCACCGGCCTCCTGCTGACCCGCGACGGCGGCACGAACAGCTCGGAGGAGATCTTCAGGCCAGCGGGAGG
CGACATGCGCGACAACTGGCGCTCCGAGCTGTACAAGTACAAGGTGGTGGAGATCCAGCCCCTGGGCATCGCACCCACCGGG
GCCAAGgagCGGGTCGTGGAGCGCGAGAAGgagGCGGCGGGCCTCGGCGCCCTGTTCCTGGGCTTCCTGGGCGCTGCGGGCT
CCACCATGGGTGCCGCGTCCATCACCCTGACCGTGCAGGCCCGCCAGCTGCTCTCCGGCATCGTGCAGCAGCAGTCCAACCT
CCTGAGGGCCATCGAGGCCCAGCAGCACATGCTGCAGCTGACCGTGTGGGGCATCAAGCAGCTGCAGGCCAGGGTGCTCGCG
CTCGAGCGCTACCTGAAGGACCAGCAGCTGCTCGGCATGTGGGGCTGCTCCGGCAAGCTGATCTGCACGACCGCGGTGGCCT
GGAACACGTCCTGGTCCAACAAGTCGGAGAAGGACATCTGGGACAACATGACCTGGATGCAGTGGGAGCGCGAGATCTCCAA
CTACACCGAGACCATCTACAAGCTCCTCGAGGACTCCCAGAACCAGCAGGAGCGGAACGAGCAGGATCTGCTCGCGCTGGAC

Figure 7 continued

```
TCGTGGAACTCCCTGTGGAACTGGTTCAACATCACCAAGTGGCTGTGGTACATCAAgTAGTgAGggtcccgaattcggtaac
cggatcc
>HV1300855_CH848.3.d0611.20.28gp140C
GgtcgacaagaaGCCACCATGCGGGTGATGGGCATCCTCAAGAACTGCCCGCAGTGGTGGATCTGGGGCATCCTGGGCTTCT
GGATGCTCATGATCTGCAACggcAAGGGCAAGCTCTGGGTGACGGTGTACTACGGCgtgCCGGTGTGGAAGGAGGCCAAGAC
GACCCTGTTCTGCGCGTCGGACGCCCGCGCCTACGAGAAGGAGGTGCACAACGTGTGGGCGACCCACGCCTGCGTGCCCACG
GACCCCAGCCCGCAGGAGCTCGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGAGATGAAGAACTGCTCCTTCAACACGACGACGGAGATCCGCGACAAGGAG
AAGAAGGAGTACGCCCTGTTCTACCGGCCCGACATCGTGCCGCTGAACGAGACCAGCAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCGCCGG
CTACGCCATCCTGAAGTGCAACAACAAGACCTTCAACGGGACCGGCCCGTGCAGCAAGGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGCACACGCCCGTGGAGATCGTGTGCACCCGCCCGGGCAACAACACGCG
CAAGTCCGTCCGGATCGGCCCTGGCCAGACCTTCTACGCCACCGGCGACATCATCGGCGACATCCGCCAGGCCCACTGCAAC
ATCAGCGAGGAGAAGTGGAACGAGACCCTGCAGAAGGTGGGCAAGGAGCTGCAGAAGCACTTCCCCAACAAGACGATTAAGT
ACGCCCAGTCGGCCGGCGGCGACATGGAGATCACCACGCACTCCTTCAACTGCGGTGGCGAGTTCTTCTACTGCAACACGTC
GAAGCTGTTCAACGGGACGTACAACGGCGCCTACATCAACATCTCGACCAACTCGAACAGCACGATCACGCTCCAGTGCCGC
ATCAAGCAGATCATCAACATGTGGCAGGGGGTGGGCCGCGCTATGTACGCACCGCCCATCGCCGGCAACATCACCTGCAAGT
CCAACATCACCGGCCTCCTGCTGACCCGCGACGGCGGCACGAACAACAAGACGGAGGAGATCTTCAGGCCAGCGGGAGGCGA
CATGCGCGACAACTGGCGCTCCGAGCTGTACAAGTACAAGGTGGTGGAGATCCAGCCCCTGGGCATCGCACCCACCGGGCC
AAGgagCGGGTCGTGGAGCGCGAGAAGgagGCGGCGGGCCTCGGCGCCCTGTTCCTGGGCTTCCTGGGCGCTGCGGGCTCCA
CCATGGGTGCCGCGTCCATCACCCTGACCGTGCAGGCCCGCCAGCTGCTCTCCGGCATCGTGCAGCAGCAGTCCAACCTCCT
GAGGGCCATCGAGGCCCAGCAGCACATGCTGCAGCTGACCGTGTGGGGCATCAAGCAGCTGCAGGCCAGGGTGCTCGCGCTC
GAGCGCTACCTGAAGGACCAGCAGCTGCTCGGCATGTGGGGCTGCTCCGGCAAGCTGATCTGCACGACCAACGTGCCCTGGA
ACACGTCCTGGTCCAACAAGTCGGAGAAGGACATCTGGGACAACATGACCTGGATGCAGTGGGAGCGCGAGATCTCCAACTA
CACCGAGACCATCTACATGCTCCTCGAGGACTCCCAGCGGCAGCAGGAGCGGAACGAGAAGGATCTGCTCGCGCTGGACTCG
TGGAACTCCCTGTGGAACTGGTTCAACATCACCAACTGGCTGTGGTACATCAAgTAGTgAGaggacccgaattcggtaaccg
gatcc
>HV1300856_CH848.3.d0700.15.06gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCGTCCTGAAGAACGTGACCGAGAACTTCAACATGTGGAAGAACAACCGGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGGACAACCGCACCGTCGGGGAGATGAAGAACTGCTCCTTCAACACGACGACGGAGATCCGCGACAAGGAG
AAGAAGGAGTACGCCCTGTTCTACAAGCCCGACGTCGTGCCGCTGGACGAGACCAACAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACAACGAGACCTTCAACCGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGAACACGCCCGTGGAGATCGTGTGCACCCGCCCGAACAACAACACGCG
CAAGTCCGTCCGGATCGGCCCTGGCCAGACCTTCTACGCCACCGGCGGCATCATCGGCGACATCCGCCAGGCCCACTGCAAC
ATCAGCGAGGGGCAGTGGAACGAGACCCTGCAGAAGGTGGGCAAGGAGCTGCAGAAGCACTTCCCCAACAAGACGATTAAGT
ACGAGCAGTCGGCCGGCGGCGACATGGAGATCACCACGCACTCCTTCAACTGCGGTGGCGAGTTCTTCTACTGCAACACGTC
GAAGCTGTTCAACGGCACGTACAACGGCACCTACATCTCCACGAACTCGTCCACCAACTCGACGAGCACGATCACGCTCCAG
TGCCGCATCAAGCAGATCATCAACATGTGGCAGGGGGTGGGCCGCGCTATGTACGCACCGCCCATCGCCGGCAACATCACCT
GCAAGTCCAACATCACCGGCCTCCTGCTGACCCGCGACGGCGGCACGAACAGCTCGGAGGAGATCTTCAGGCCAGCGGGAGG
CGACATGCGCGACAACTGGCGCTCCGAGCTGTACAAGTACAAGGTGGTGGAGATCCAGCCCCTGGGCATCGCACCCACCGGG
GCCAAGgagCGGGTCGTGGAGCGCGAGAAGgagGCGGCGGGCCTCGGCGCCCTGTTCCTGGGCTTCCTGGGCGCTGCGGGCT
CCACCATGGGTGCCGCGTCCATCACCCTGACCGTGCAGGCCCGCCAGCTGCTCTCCGGCATCGTGCAGCAGCAGTCCAACCT
CCTGAGGGCCATCGAGGCCCAGCAGCACATGCTGCAGCTGACCGTGTGGGGCATCAAGCAGCTGCAGGCCAGGGTGCTCGCG
CTCGAGCGCTACCTGAAGGACCAGCAGCTGCTCGGCATGTGGGGCTGCTCCGGCAAGCTGATCTGCACGACCAACGTGCCCT
GGAACACGTCCTGGTCCAACAAGTCGGAGAAGGACATCTGGGACAACATGACCTGGATGCAGTGGGAGCGCGAGATCTCCAA
CTACACCGAGACCATCTACAAGCTCCTCGAGGACTCCCAGAACCAGCAGGAGCGGAACGAGCAGGATCTGCTCGCGCTGGAC
```

Figure 7 continued

TCGTGGAACTCCCTGTGGAACTGGTTCAACATCACCAAGTGGCTGTGGTACATCAAgTAGTgAGaggtcccgaattcggtaa
ccggatcc
>HV1300857_CH848.3.d0700.15.15gp140C
GgtcgacaagaaGCCACCATGCGGGTGACGGGCATCCTCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGACTCGCGGTCCAACGACAACGTGACCTCGATCAACAACACGATCATGGGG
GAGATGAAGAACTGCTCCTTCAACACGACGACGGAGATCCGCGACAAGGAGAAGAAGGAGTACGCCCTGTTCTACCGCCCCG
ACATCGTGCCGCTGAACGAGACCAGCAACACCTCGGAGTACAGGCTGATCAACTGCAACACCTCCGCGGTCACGCAGGCGTG
CCCCAAGGTCACGTTCGAGCCCATCCCCATCCACTACTGCGCCCCCGCCGGCTACGCCATCCTGAAGTGCAACGACGAGACC
TTCAACGGGACCGGCCCGTGCAGCAACGTGTCCACCGTGCAGTGCACGCACGGCATCCGGCCCGTGGTGTCCACGCAGCTGC
TCCTGAACGGGTCGCTGGCGGAGAAGGAGATCGTCATCCGGTCCGAGAACCTCACGAACAACGCGAAGATCATCATCGTGCA
CCTGCACACGCCCGTGGAGATCGTGTGCACCCGCCCGGGCAACAACACGCGCAAGTCCGTCCGGATCGGCCCTGGCCAGACC
TTCTACGCCACCGGCGACATCATCGGCGACATCCGCCAGGCCCACTGCAACATCAGCGAGGAGAAGTGGAACAAGACCCTGC
AGAAGGTGGGCAAGGAGCTGCAGAAGCACTTCCCCAACAAGACGATTAAGTACGAGCGCCCCGCCGGCGGCGACCTGGAGAT
CACCACGCACTCCTTCAACTGCGGTGGCGAGTTCTTCTACTGCAACACGTCGAAGCTGTTCAACGGCACGTACAACGGCACC
GACATCTCCACGAACTCGTCCACCAACTCGACGAGCACGATCACGCTCCAGTGCCGCATCAAGCAGATCATCAACATGTGGC
AGGGGGTGGGCCGCGCTATGTACGCACCGCCCATCGCCGGCAACATCACCTGCAAGTCCAACATCACCGGCCTCCTGCTGAC
CCGCGACGGCGGCACGAACAGCTCGGAGGAGATCTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAGAAGg
agGCGGCGGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATGTGGGGCTGCTCCGGCAAGCTGATCTGCACGACCAACGTGCCCTGGAACACGTCCTGGTCCAACAAGTCGGAGAA
GGACATCTGGGACAACATGACCTGGATGCAGTGGGAGCGCGAGATCTCCAACTACACCGAGACCATCTACAAGCTCCTCGAG
GACTCCCAGAACCAGCAGGAGCGGAACGAGAAGGATCTGCTCGACCTCGTGGAACTCCCTGTGGAACTGGTTCAACA
TCACCAAGTGGCTGTGGTACATCAAgTAGTgAGggacctgaattcggtaaccggatcc
>HV1300858_CH848.3.d0700.15.29gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcAAGGGGAAGCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTGCTGGGGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGACTCGCGGTCCAACGACAACGTGACCTCGATCAACAACACGATCATGGGG
GAGATGAAGAACTGCTCCTTCAACACGACGACGGAGATCCGCGACAAGGAGAAGAAGGAGTACGCCCTGTTCTACCGCCCCG
ACATCGTGCCGCTGAACGAGAACGAGACCAGCAACACCTCGGAGTACAGGCTGATCAACTGCAACACCTCCGCGGTCACGCA
GGCGTGCCCCAAGGTCACGTTCGAGCCCATCCCCATCCACTACTGCGCCCCCGCCGGCTACGCCATCCTGAAGTGCAACAAC
GAGACCTTCAACGGGACCGGCCCGTGCAGCAACGTGTCCACCGTGCAGTGCACGCACGGCATCCGGCCCGTGGTGTCCACGC
AGCTGCTCCTGAACGGGTCGCTGGCGGAGAAGGAGATCGTCATCCGGTCCGAGAACCTCACGAACAACGCGAAGATCATCAT
CGTGCACCTGCACACGCCCGTGGAGATCGTGTGCACCCGCCCGGGCAACAACACGCGCAAGTCCGTCCGGATCGGCCCTGGC
CAGACCTTCTACGCCACCGGCGACATCATCGGCGACATCCGCCAGGCCCACTGCAACATCAGCGAGGAGAAGTGGAACGAGA
CCCTGCAGAAGGTGGGCAAGGAGCTGCAGAAGCACTTCCCCAACAAGACGATTAAGTACGCGCAGTCGGCCGGCGGCGACAT
GGAGATCACCACGCACTCCTTCAACTGCGGTGGCGAGTTCTTCTACTGCAACACGTCGAACCTGTTCAACGGCACGTACAAC
GGCACCTACATCTCCACGAACTCGTCCGCCAACTCGACGAGCACGATCACGCTCCAGTGCCGCATCAAGCAGATCATCAACA
TGTGGCAGGGGGTGGGCCGCGCTATGTACGCACCGCCCATCGCCGGCAACATCACCTGCAAGTCCAACATCACCGGCCTCCT
GCTGACCCGCGACGGCGGCACGAACAACACCAGCAACGAGGAGACGTTCAGGCCAGCGGGAGGCGACATGCGCGACAACTGG
CGCTCCGAGCTGTACAAGTACAAGGTGGTGGAGATCCAGCCCCTGGGCATCGCACCCACCGGGGCCAAGgagCGGGTCGTGG
AGCGCGAGAAGgaggCGGCGGGCCTCGGCGCCCTGTTCCTGGGCTTCCTGGGCGCTGCGGGCTCCACCATGGGTGCCGCGTC
CATCACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTGAAGG
ACCAGCAGCTGCTCGGCATGTGGGGCTGCTCCGGCAAGCTGATCTGCACGACCGCCGTGCCCTGGGACTCGTCCTGGTCCAA
CAAGTCGGAGAAGGACATCTGGGACAACATGACCTGGATGCAGTGGGAGCGCGAGATCTCCAACTACACCGAGACCATCTAC

Figure 7 continued

```
AAGCTCCTCGAGGACTCCCAGAACCAGCAGGAGCGGAACGAGCAGGATCTGCTCGCGCTGGACTCGTGGAACTCCCTGTGGA
ACTGGTTCAACATCACCAACTGGCTGTGGTACATCAAgTAGTgAGggtcctgaattcggtaaccggatcc
>HV1300859_CH848.3.d0700.27.06gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAAGggcAAGGGGAACCTCTGGGTGACGGTGTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAACAACCGCACCGTCTACGAGATGAAGAACTGCTCCTTCAACACGACGACGGAGATCCGCGACAAGGAG
AAGAAGGAGTACGCCCTGTTCTACCGCTCGGACGTCGTGCCGCTGGACGAGACCAACAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCGCCGG
CTACGCCATCCTGAAGTGCAACAACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGCACACGCCCGTGGAGATCGTGTGCACCCGCCCGGGCAACAACACGCG
CAAGTCCGTCCGGATCGGCCCTGGCCAGACCTTCTACGCCACCGGCGACATCATCGGCGAGATCCGCCAGGCCCACTGCAAC
ATCAGCGAGTCGAAGTGGAACGAGACCCTGCAGAAGGTGGGCAAGGAGCTGCAGAAGCACTTCCCCAACAAGACGATTAAGT
ACGAGCGCTCGGCCGGCGGCGACATGGAGATCACCACGCACTCCTTCAACTGCGGTGGCGAGTTCTTCTACTGCAACACGTC
GAAGCTGTTCAACGGCACGTACAACGGCACCGACATCTCCACGAACTCGTCCGCCAACTCGAACAGCACGATCACGCTCCAG
TGCCGCATCAAGCAGATCATCAACATCTGGCAGGGGGTGGGCCGCGCTATGTACGCACCGCCCATCGCCGGCAACATCACCT
GCAAGTCCAACATCACCGGCCTCCTGCTGACCCGCGACGGCGGCAACAACAACAACCGGAACGAGGAGACGTTCAGGCCAGC
GGGAGGCGACATGCGCGACAACTGGCGCTCCGAGCTGTACAAGTACAAGGTGGTGGAGATCCAGCCCCTGGGCATCGCACCC
ACCGGGGCCAAGgagCGGGTCGTGGAGCGCGAGAAGgagGCGGCGGGCCTCGGCGCCCTGTTCCTGGGCTTCCTGGGCGCTG
CGGGCTCCACCATGGGTGCCGCGTCCATCACCCTGACCGTGCAGGCCCGCCAGCTGCTCTCCGGCATCGTGCAGCAGCAGTC
CAACCTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACCAACG
TGCCCTGGAACACGTCCTGGTCCAACAAGTCGGAGAAGGACATCTGGGACAACATGACCTGGATGCAGTGGGAGCGCGAGAT
CTCCAACTACACCGAGACCATCTACATGCTCCTCGAGGACTCCCAGCGGCAGCAGGAGCGGAACGAGAAGGATCTGCTCGCG
CTGGACTCGTGGAACTCCCTGTGGAACTGGTTCAACATCACCAACTGGCTGTGGTACATCAAgTAGTgAGggtcccgaattc
ggttaccggatcc
>HV1300860_CH848.3.d0794.5.27gp140C
GgtcgacaagaaGCCACCATGCGGGTGATGGGCATCCCCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCCGGGCCTACGAGAAGGAGGTGCACAACGTGTGGGCGACCCACGCCTGCGTGCCCACG
GACCCCAGCCCGCAGGAGCTCGTCCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGGACAACCGCACCGTCGGCGAGATGAAGAACTGCTCCTTCAACACGACGACGGAGATCCGCGACAAGGAG
AAGAAGGAGTACGCCCTGTTCTACCGCCCGGACATCGTGCCGCTGTCCGAGACCAACAACACCTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACAACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGAACACGCCCGTGGAGATCGTGTGCACCCGCCCGAACAACAACACGCG
CAAGTCCGTCCGGATCGGCCCTGGCCAGACCTTCTACGCCACCGGCGACATCATCGGCGAGATCAAGCAGGCCCACTGCAAC
ATCAGCGAGGAGAAGTGGAACGAGACCCTGCAGAAGGTGGGCAAGGAGCTGCAGAAGCACTTCCCCAACAAGATCATTAAGT
ACGCCCAGTCGGCCGGCGGCGACATGGAGATCACCACGCACTCCTTCAACTGCGGTGGCGAGTTCTTCTACTGCAACACGGC
GAACCTGTTCAACGGCACGTACAACGGCACCGACATCTCCACGAACTCGTCCACCAAGTCGAACAGCACGATCACGCTCCAG
TGCCGCATCAAGCAGATCATCAACATGTGGCAGGGGGTGGGCCGCGCTATGTACGCACCGCCCATCGCCGGCAACATCACCT
GCCGGTCCACCATCACCGGCCTCCTGCTGACCCGCGACGGCGGCACGAACTCGAGCAAGACGGAGGAGGAGACGTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGAAGACCGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTC
```

Figure 7 continued

GCGCTGGACTCGTGGAACTCCCTGTGGAACTGGTTCAACATCACCAAGTGGCTGTGGTACATCAAgTAGTgAGaggacccga
attcggttaccggatcc
>HV1300861_CH848.3.d0794.5.41gp140C
GgtcgacaagaaGCCACCATGCGGGTGATGGGCATCCTCAAGAACTACCCGCAGTGGTGGATCTGGGGCATCCTGGGCTTCT
GGATGCTCATGATCTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACCGCACCGTCGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACAACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGAACACGCCCGTGGAGATCGTGTGCACCCGCCCGAACAACAACAC
GCGCAAGTCCGTCCGGATCGGCCCTGGCCAGACCTTCTACGCCACCGGCGACATCATCGGCGACATCCGGCAGGCCCACTGC
AACATCAGCGAGAAGGAGTGGAACGACACCCTGCAGAAGGTGGGCAAGGAGCTGCAGAAGCACTTCCCCAACAAGACCATTG
AGTACAAGCAGTCGGCCGGCGGCGACATGGAGATCACCACGCACTCCTTCAACTGCGGTGGCGAGTTCTTCTACTGCAACAC
GTCCAACCTGTTCAACGGCACGTACAACGGCACCTACATGAACATCTCCACCGACTCGAACAGCACGATCACGCTCCAGTGC
CGCATCAAGCAGATCATCAACATGTGGCAGGGGGTGGGCCGCGCTATGTACGCACCGCCCATCGCCGGCAACATCACCTGCC
GGTCCAACATCACCGGCCTCCTGCTGACCCGCGACGGCGGCACGAACTCGAGCAAGACGGAGGAGGAGACGTTCAGGCCAGC
GGGAGGCGACATGCGCGACAACTGGCGCTCCGAGCTGTACAAGTACAAGGTGGTGGAGATCCAGCCCCTGGGCATCGCACCC
ACCGGGGCCAAGgagCGGGTCGTGGAGCGCGAGAAGgagGCGGCGGGCCTCGGCGCCCTGTTCCTGGGCTTCCTGGGCGCTG
CGGGCTCCACCATGGGTGCCGCGTCCATCACCCTGACCGTGCAGGCCCGCCAGCTGCTCTCCGGCATCGTGCAGCAGCAGTC
CAACCTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACCAACG
TGCCCTGGAACACGTCCTGGTCCAACAAGTCGGAGAAGGACATCTGGGACAACATGACCTGGATGCAGTGGGAGCGCGAGAT
CTCCAACTACACCGAGACCATCTACAAGCTCCTCGAGGACTCCCAGAACCAGCAGGAGCGGAACGAGCAGGATCTGCTCGCG
CTGGACTCGTGGAACTCCCTGTGGAACTGGTTCAACATCACCAAGTGGCTGTGGTACATCAAgTAGTgAGaggtcccgaatt
cggttaccggatcc
>HV1300862_CH848.3.d0836.10.36gp140C
GgtcgacaagaaGCCACCATGCGGGTGATGGGCATCCTCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACTCCACCGTCGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGGGATCGTCATCCGGTCCGAGA
ACCTCACGAACAACGCGAAGATCATCATCGTGCACCTGCACACGCCCGTGGAGATCGTGTGCACCCGCCCGAACAACAACAC
GCGCAAGTCCGTCCGGATCGGCCCTGGCCAGACCTTCTACGCCACCGGCGACATCATCGGCGACATCCGGCAGGCCCACTGC
AACATCAGCGAGTCCAAGTGGAACGAGACCCTGCAGAAGGTGGGCAAGGAGCTGCAGAAGCACTTCCCCAACAAGACCATTA
AGTACGAGCAGTCGGCCGGCGGCGACATGGAGATCACCACGCACTCCTTCAACTGCGGTGGCGAGTTCTTCTACTGCACCAC
GTCCAAGCTGTTCAACGGGACGTACAACGGCACGGACATCTCCACGAACTCCTCGGCGAACTCGAACCCGACGATCACGCTC
CAGTGCCGCATCAAGCAGATCATCAACATGTGGCAGGGGGTGGGCCGCGCTATGTACGCACCGCCCATCGCCGGCAACATCA
CCTGCAAGTCCAACATCACCGGCCTCCTGCTGACCCGCGACGGCGGCACGAACTCGAGCGGGAAGGAGGAGATCTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGACCGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTC

Figure 7 continued

GCGCTGGACTCGTGGAACTCCCTGTGGAACTGGTTCAACATCACCAAGTGGCTGTGGTACATCAAgTAGTgAGggacctgaa
ttcggttaccggatcc
>HV1300863_CH848.3.d0864.7.26gp140C
GgtcgacaagaaGCCACCATGCGCGTGACCGGCATCCTCAAGAACTACCCGCAGTGGTGGATCTGGGGCATCCTGGGCTTCT
GGATGCTCATGAACTGCAACggcAAGGAGAACCTCTGGGTGACGGTGTACTACGGCgtgCCGGTGTGGAAGGAGGCCAAGAC
GACCCTGTTCTGCGCGTCGGACGCCCGGGCCTACGAGAAGGAGGTGCACAACGTGTGGGCGACCCACGCCTGCGTGCCCACG
GACCCCAGCCCGCAGGAGCTCGTGCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACTCCACGGTGGACGAGATGAAGAACTGCTCCTTCAACACGACGACGGAGATCCGCGACAAGGAG
AAGAAGGAGTACGCCCTGTTCTACCGCCCGGACATCGTGCCGCTGAACGAGAACGAGACGTCGAACACCTCGGAGTACAGGC
TGATCAACTGCAACACCTCCGCGGTCACGCAGGCGTGCCCCAAGGTCACGTTCGAGCCCATCCCCATCCACTACTGCGCCCC
CGCCGGCTACGCCATCCTGAAGTGCAACGACGAGACCTTCAACGGGACCGGCCCGTGCAGCAACGTGTCCACCGTGCAGTGC
ACGCACGGCATCCGGCCCGTGGTGTCCACGCAGCTGCTCCTGAACGGGTCGCTGGCGGAGAAGGAGATCGTCATCCGGTCCG
AGAACCTCACGAACAACGCGAAGATCATCATCGTGCACCTGAACACGCCCGTGGAGATCGTGTGCACCCGCCCGAACAACAA
CACGCGCAAGTCCGTCCGGATCGGCCCTGGCCAGACCTTCTACGCCACCGGCGACATCATCGGCGACATCCGGCAGGCCCAC
TGCAACATCAGCGAGAAGGAGTGGAACGAGACCCTGCAGAAGGTGGGCAAGGAGCTGCAGAAGCACTTCCCCAACAAGACCA
TTAAGTACGCGCAGTCGGCCGGCGGCGACATGGAGATCACCACGCACTCCTTCAACTGCGGTGGCGAGTTCTTCTACTGCAA
CACGGCCAACCTGTTCAACGGGACGTACAACGGGACATCTCCACGAACTCCTCGACGAAGTCGAACTCGACGATCACG
CTCCAGTGCCGCATCAAGCAGATCATCAACATGTGGCAGGGGGTGGGCCGCGCTATGTACGCACCGCCCATCGCCGGCAACA
TCACCTGCCGGTCCACCATCACCGGCCTCCTGCTGACCCGCGACGGCGGCAACAACTCGAGCAAGACGGAGGAGGAGACCTT
CAGGCCAGCGGGAGGCGACATGCGCGACAACTGGCGCTCCGAGCTGTACAAGTACAAGGTGGTGGAGATCCAGCCCCTGGGC
ATCGCACCCACCGGGGCCAAGgagCGGGTCGTGGAGCGCGAGAAGgagGCGGCGGGCCTCGGCGCCCTGTTCCTGGGCTTCC
TGGGCGCTGCGGGCTCCACCATGGGTGCCGCGTCCATCACCCTGACCGTGCAGGCCCGCCAGCTGCTCTCCGGCATCGTGCA
GCAGCAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATCTGCA
CGACCAACGTGCCCTGGAACACGTCCTGGTCCAACAAGTCGAAGACCGACATCTGGGACAACATGACCTGGATGCAGTGGGA
GCGCGAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCAACATCACCAAGTGGCTGTGGTACATCAAgTAGTgAGggt
cctgaattcggttaccggatcc
>HV1300864_CH848.3.d0864.7.39gp140C
GgtcgacaagaaGCCACCATGCGCGTGATGGGCATCCCCAAGAACTGCCCGCAGTGGTGGATCTGGGGCATCCTGGGCTTCT
GGATGCTCATGATCTGCAACggcAAGGGGAAGCTCTGGGTGACGATCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACTCCACGGTGGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGAACACGCCCGTGGAGATCGTGTGCACCCGCCCGAACAACAACAC
GCGCAAGTCCGTCCGGATCGGCCCTGGCCAGACCTTCTACGCCACCGGCGACATCATCGGCGACATCCGGCAGGCCCACTGC
AACATCAGCGAGAAGGAGTGGAACGACACCCTGCAGAAGGTGGGCAAGGAGCTGCAGAAGCACTTCCCCAACAAGACCATTG
AGTACAAGCAGTCGGCCGGCGGCGACATGGAGATCACCACGCACTCCTTCAACTGCGGTGGCGAGTTCTTCTACTGCAACAC
GGCCAAGCTGTTCAACGGGACGTACAACGGGACATCTCCACGAACTCCTCGGCGGACTCGAACTCGACGATCACGCTC
CAGTGCCGCATCAAGCAGATCATCAACATGTGGCAGGGGGTGGGCCGCGCTATGTACGCACCGCCCATCGCCGGCAACATCA
CCTGCAAGTCCCACATCACCGGCCTCCTGCTGACCCGCGACGGCGGCACCAACTCGAGCGAGGAGGAGGAGATCTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGACCGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTC

Figure 7 continued

```
GCGCTGGACTCGTGGAACTCCCTGTGGAACTGGTTCAACATCACCAAGTGGCTGTGGTACATCAAgTAGTgAGaattcggtg
accgggacccggatcc
>HV1300865_CH848.3.d0893.10.06gp140C
GgtcgacaagaaGCCACCATGCGCGTGACGGGCATCCTCAAGAACTACCCGCAGTGGTGGATCTGGGGCATCCTGGGCTTCT
GGATGCTCATGAACTGCAACggcAAGGAGAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACTCCACGGTGGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCCGTGGAGATCGTGTGCACCCGCCCGAACAACAACAC
GCGCAAGTCCGTCCGGATCGGCCCTGGCCAGACCTTCTACGCCACCGGCGACATCATCGGCGACACGCGGCAGGCCCACTGC
AACATCAGCGAGAAGAAGTGGAACGAGACCCTGCAGAAGGTGGGCATCGAGCTGCAGAAGCACTTCCCCAACAAGACCATTA
AGTACAACCAGTCGGCCGGCGGCGACATGGAGATCACCACGCACTCCTTCAACTGCGGTGGCGAGTTCTTCTACTGCAACAC
GTCGAACCTGTTCAACGGGACGTACAACGGCACCTACATCTCCACGAACTCCTCGGCGAACTCGACCTCGACGATCACGCTC
CAGTGCCGCATCAAGCAGATCATCAACATGTGGCAGGGGGTGGGCCGCGCTATGTACGCACCGCCCATCGCCGGCAACATCA
CCTGCCGGTCCAACATCACCGGCCTCCTGCTGACCCGCGACGGCGGCACCAACTCGAACGAGACGGAGACCTTCAGGCCAGC
GGGAGGCGACATGCGCGACAACTGGCGCTCCGAGCTGTACAAGTACAAGGTGGTGGAGATCCAGCCCCTGGGCATCGCACCC
ACCGGGGCCAAGgagCGGGTCGTGGAGCGCGAGAAGgagCGGCGGGCCTCGGCGCCCTGTTCCTGGGCTTCCTGGGCGCTG
CGGGCTCCACCATGGGTGCCGCGTCCATCACCCTGACCGTGCAGGCCCGCCAGCTGCTCTCCGGCATCGTGCAGCAGCAGTC
CAACCTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACCAACG
TGCCCTGGAACACGTCCTGGTCCAACAAGTCGGAGACCGACATCTGGGACAACATGACCTGGATGCAGTGGGAGCGCGAGAT
CTCCAACTACACCGAGACCATCTACAAGCTCCTCGAGGACTCCCAGAACCAGCAGGAGCGGAACGAGCAGGATCTGCTCGCG
CTGGACTCGTGGAACTCCCTGTGGAACTGGTTCTCGATCACCAAGTGGCTGTGGTACATCAAgTAGTgAGaattcggtcacc
gggacccggatcc
>HV1300866_CH848.3.d1120.10.13gp140C
GgtcgacaagaaGCCACCATGCGCGTGACGGGCATCCTCAAGAACTACCCGCAGTGGTGGATCTGGGGCATCCTGGGCTTCT
GGATGCTCATGAACTGCAACggcAAGGAGAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GCACGCCACGGTGGAGAACTCCACGACCGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCCGTGGAGATCGTGTGCACCCGCCCGAACAACAACAC
GCGCAAGTCCGTCCGGATCGGCCCTGGCCAGACCTTCTACGCCACCGGCGACATCATCGGCGAGATCCGGCAGGCCCACTGC
AACATCAGCAAGGAGACCTGGAACGACACCCTGCAGAAGGTGGGCAAGGAGCTGCAGAAGCACTTCCCCAACAAGACCATCC
GCTACAACCAGTCGGCCGGCGGCGACATGGAGATCACCACGCACTCCTTCAACTGCGGTGGCGAGTTCTTCTACTGCAACAC
GGCCAAGCTGTTCAACTCGACGTACAACGGCACCTACATCTCCACGAACTCCACGAACTCGACCTCGTACATCACGCTCCAG
TGCCGCATCAAGCAGATCATCAACATGTGGCAGGGGGTGGGCCGCGCTATGTACGCACCGCCCATCGCCGGCAACATCACCT
GCCGGTCCAACATCACCGGCCTCCTGCTGACCCGCGACGGCGGCACCAACTCGTCGGAGGAGGAGATCTTCAGGCCAGCGGG
AGGCGACATGCGCGACAACTGGCGCTCCGAGCTGTACAAGTACAAGGTGGTGGAGGTGCAGCCCCTGGGCATCGCACCCACC
GGGGCCAAGgagCGGGTCGTGGAGCGCGAGAAGgagCGGCGGGCCTCGGCGCCCTGTTCCTGGGCTTCCTGGGCGCTGCGG
GCTCCACCATGGGTGCCGCGTCCATCACCCTGACCGTGCAGGCCCGCCAGCTGCTCTCCGGCATCGTGCAGCAGCAGTCCAA
CCTCCTGAGGGCCATCGAGGCCCAGCAGCACATGCTGCAGCTGACCGTGTGGGGCATCAAGCAGCTGCAGGCCAGGGTGCTC
GCGCTCGAGCGCTACCTGAAGGACCAGCAGCTGCTCGGCATGTGGGGCTGCTCCGGCAAGCTGATCTGCACGACCAACGTGC
CCTGGAACACGTCCTGGTCCAACAAGTCGGAGACCGACATCTGGGACAACATGACCTGGATGCAGTGGGAGCGCGAGATCTC
CAACTACACCGAGACCATCTACAAGCTCCTCGAGGACTCCCAGAACCAGCAGGAGCGGAACGAGCAGGATCTGCTCGCGCTG
```

Figure 7 continued

```
GACTCGTGGAACTCCCTGTGGAACTGGTTCTCGATCACCAAGTGGCTGTGGTACATCAAgTAGTgAGaattcggtaaccggg
acccggatcc
>HV1300867_CH848.3.d1120.10.21gp140C
GgtcgacaagaaGCCACCATGCGCGTGACGGGCATCCTCAAGAACTACCCGCAGTGGTGGATCTGGGGCATCCTGGGCTTCT
GGATGCTCATGATCTGCAACggcGAGGAGAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATGTGCTC
GAACGCCATCGTGAAGAACTCCACGACCGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACAAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCCGTGCAGATCGTGTGCACCCGCCCGAACAACAACAC
GCGCAAGTCCGTCCGGATCGGCCCTGGCCAGACCTTCTACGCCACCGGCGACATCATCGGCGACCCGCGGCAGGCCCACTGC
AACATCAGCGAGAAGAAGTGGAACGAGACCCTGCAGAAGGTGGGCATCGAGCTGCAGAAGCACTTCCCCAACAAGACCATCA
AGTACAACCAGTCGGCCGGCGGCGACATGGAGATCACCACGCACTCCTTCAACTGCGGTGGCGAGTTCTTCTACTGCAACAC
GGCCAAGCTGTTCAACTCGACGTACAACGGCACCTACATCTCCACGAACTCCACGGACTCGACCTCGAACATCACGCTCCAG
TGCCGCATCAAGCAGATCATCAACATGTGGCAGGGGGTGGGCCGCGCTATGTACGCACCGCCCATCGCCGGCAACATCACCT
GCCGGTCCAACATCACCGGCCTCCTGCTGACCCGCGACGGCGGCATCAACAACGACTCGAACGAGACGGAGACCTTCAGGCC
AGCGGGAGGCGACATGCGCGACAACTGGCGCTCCGAGCTGTACAAGTACAAGGTGGTGGAGGTGCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGACCGACATCTGGGACAACATGACCTGGATGCAGTGGGAGCGCGA
GATCTCCAACTACACCGAGACCATCTACAAGCTCCTCGAGGACTCCCAGAACCAGCAGGAGCGGAACGAGCAGGATCTGCTC
GCGCTGGACTCGTGGAACTCCCTGTGGAACTGGTTCTCGATCACCAAGTGGCTGTGGTACATCAAgTAGTgAGaattcggtt
accgggacccggatcc
>HV1300868_CH848.3.d1120.10.24gp140C
GgtcgacaagaaGCCACCATGCGCGTGATGGGCATCCTCAAGAACTACCCGCGCTGGTGGATCTGGGGCATCCTGGGCTTCT
GGATGCTCATGATCTGCAACggcAAGGGCAAGCTCTGGGTGACGGTCTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTCCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GACGGCCACGGTGAACAAGTCCACGGTGGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCCGTGGAGATCGTGTGCACCCGCCCGAACAACAACAC
GCGCAAGTCCGTCCGGATCGGCCCTGGCCAGACCTTCTACGCCACCGGCGGGATCGTCGGCGACATCCGGCAGGCCCACTGC
AACATCAGCAAGGGCCTCTGGAACGACACCCTGCAGAAGGTGGGCATCGAGCTGCAGAAGCACTTCCCCAACAAGACCATCA
AGTACAACCAGTCGGCCGGCGGCGACATGGAGATCACCACGCACTCCTTCAACTGCGGTGGCGAGTTCTTCTACTGCAACAC
GAGCAACCTGTTCAACGGCACGTACAACGGCACCTACATCTCCACGAACTCGTCCGCGAACTCGACCTCGTACATCACGCTC
CAGTGCCGCATCAAGCAGATCATCAACATGTGGCAGGGGGTGGGCCGCGCTATGTACGCACCGCCCATCGCCGGCAACATCA
CCTGCCGGTCCAACATCACCGGCCTCCTGCTGACCCGCGACGGCGGCACGACCAACAACTCGAACGAGACGGAGACCTTCAG
GCCAGCGGGAGGCGACATGCGCGACAACTGGCGCTCCGAGCTGTACAAGTACAAGGTGGTGGAGATCCAGCCCCTGGGCATC
GCACCCACCGGGGCCAAGgagCGGGTCGTGGAGCGCGAGAAGgagGCGGCGGGCCTCGGCGCCCTGTTCCTGGGCTTCCTGG
GCGCTGCGGGCTCCACCATGGGTGCCGCGTCCATCACCCTGACCGTGCAGGCCCGCCAGCTGCTCTCCGGCATCGTGCAGCA
GCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGCACGA
CCAACGTGCCCTGGAACACGTCCTGGTCCAACAAGTCGGAGACCGACATCTGGGACAACATGACCTGGATGCAGTGGGAGCG
CGAGATCTCCAACTACACCGAGACCATCTACAAGCTCCTCGAGGACTCCCAGAACCAGCAGGAGCGGAACGAGCAGGATCTG
```

Figure 7 continued

```
CTCGCGCTGGACTCGTGGAACTCCCTGTGGAACTGGTTCTCGATCACCAAGTGGCTGTGGTACATCAAgTAGTgAGaattcg
gtgaccgggtcccggatcc
>HV1300869_CH848.3.d1120.10.32gp140C
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACGgcAAGGGCAAGCTCTGGGTGACGGTCTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCGTCCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTGGAGAACGGCACGGTGGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACGAGACGTCGAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGGCATCGTCATCCGGTCCGAGA
ACCTCACGAACAACGCGAAGATCATCATCGTGCAGCTGAACACGTCCGTGGAGATCGTGTGCACCCGCCCGAACAACAACAC
GCGCAAGTCCGTCCGGATCGGCCCTGGCCAGACCTTCTACGCCACCGGCGACATCATCGGCGACCCGCGGCAGGCCCACTGC
AACATCAGCAAGGAGAAGTGGAACGACACCCTGCAGAAGGTGGGCAAGGAGCTGCAGAAGCACTTCCCCAACAAGACCATCC
GCTACAACCAGTCGGCCGGCGGCGACATGGAGATCACCACGCACTCCTTCAACTGCGGTGGCGAGTTCTTCTACTGCAACAC
GGCGAAGCTGTTCAACAGCACGTACAACGGCACCTACATCTCCACGAACTCGACGAACTCGACCTCGAACATCACGCTCCAG
TGCCGCATCAAGCAGATCATCAACATGTGGCAGGGGGTGGGCCGCGCTATGTACGCACCGCCCATCGCCGGCAACATCACCT
GCCGGTCCAACATCACCGGCCTCCTGCTGACCCGCGACGGCGGCACGACCAACAACTCGAACGAGACGGAGACCTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGACCGACATCTGGGACAACATGACCTGGATGCAGTGGGAGCGCGA
GATCTCCAACTACACCGGGACCATCTACAAGCTCCTCGAGGACTCCCAGAACCAGCAGGAGCGGAACGAGCAGGATCTGCTC
GCGCTGGACTCGTGGAACTCCCTGTGGAACTGGTTCAACATCACCAAGTGGCTGTGGTACATCAAgTAGTgAGaattcggtg
accaggacccggatcc
>HV1300870_CH848.3.d1120.10.41gp140C
GgtcgacaagaaGCCACCATGCGCGTGATGGGCATCCAGAAGAACTACCCGCGCTGGTGGATCTGGGGCATCCTGGGCTTCT
GGATGCTCATGATCTGCAACGgcGAGGGCAAGCTCTGGGTGACGGTCTACTACGGCgtgCCGGTGTGGAAGGAGGCCAAGAC
GACCCTGTTCTGCGCGTCGGACGCCCGCGCCTACGAGAAGGAGGTGCACAACGTGTGGGCGACCCACGCCTGCGTGCCCACG
GACCCCAGCCCGCAGGAGCTCGTCCTGGGCAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGAAGAACTCGACCACGGAGGAGATGAAGAACTGCTCCTTCAACACGACGACGGAGATCCGCGACAAGGAG
AAGAAGGAGCACGCCCTGTTCTACCGCCCGGACATCGTGCCGCTGAACAACGAGACGGGCAACACCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCAGCTGAACACGTCCGTGGAGATCGTGTGCACCCGCCCGAACAACAACAC
GCGCAAGTCCGTCCGGATCGGCCCTGGCCAGACCTTCTACGCCACCGGCGACATCATCGGCGACATCAAGCAGGCCCACTGC
AACATCAGCGAGGAGAAGTGGAACGACACCCTGCAGAAGGTGGGCATCGAGCTGCAGAAGCACTTCCCCAACAAGACCATCA
AGTACAACCAGTCGGCCGGCGGCGACATGGAGATCACCACGCACTCCTTCAACTGCGGTGGCGAGTTCTTCTACTGCAACAC
GTCGAAGCTGTTCAACAGCACGTACAACGGCACCTACATCTCCACGAACTCGACGAACTCGACCTCGTACATCACGCTCCAG
TGCCGCATCAAGCAGATCATCAACATGTGGCAGGGGGTGGGCCGCGCTATGTACGCACCGCCCATCGCCGGCAACATCACCT
GCCGGTCCAACATCACCGGCCTCCTGCTGACCCGCGACGGCGGCATCAACAACGACTCGAACGAGACGGAGACCTTCAGGCC
AGCGGGAGGCGACATGCGCGACAACTGGCGCTCCGAGCTGTACAAGTACAAGGTGGTGGAGATCCAGCCCCTGGGCATCGCA
CCCACCGGGGCCAAGgagCGGGTCGTGGAGCGCGAGAAGgagGCGGCGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGATGGACATCTGGGACAACATGACCTGGATGCAGTGGGAGCGCGA
GATCTCCAACTACACCGGGACCATCTACAAGCTCCTCGAGGACTCCCAGAACCAGCAGGAGCGGAACGAGCAGGATCTGCTC
```

Figure 7 continued

```
GCGCTGGACTCGTGGAACTCCCTGTGGAACTGGTTCAACATCACCAAGTGGCTGTGGTACATCAAgTAGTgAGaattcggtg
accaggtcccggatcc
>HV1300871_CH848.3.d1305.10.13gp140C
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACggcAAGGGCAAGCTCTGGGTGACGGTCTACTACGGCgtgCCGGTGTGGAAGGAGGCCAAGAC
GACCCTGTTCTGCGCGTCGGACGCCCGGGCCTACGAGAAGGAGGTGCACAACGTGTGGGCGACCCACGCCTGCGTGCCCACG
GACCCCAGCCCGCAGGAGCTCGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GATCGCCACGGCGAACGGCTCGACGGTGGAGGAGATGAAGAACTGCTCCTTCAACACGACGACGGAGATCCGCGACAAGGAG
AAGAAGGAGTACGCCCTGTTCTACCGCCCGGACATCGTGCCGCTGAACAACAAGACGTCGAACATCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACAACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCGGTGGAGATCGTGTGCACCCGCCCGAACAACAACAC
GCGCAAGTCCGTCCGGATCGGCCCTGGCCAGACCTTCTACGCCACCGGCGACATCATCGGCAACCCGCGGCAGGCCCACTGC
AACATCAGCAAGGAGCGGTGGAACGACACCCTGCAGAAGGTGGGCAAGGAGCTGCAGAAGCACTTCCCCAACAAGACCATCC
GCTACAACCAGTCGGCCGGCGGCGACATGGAGATCACCACGCACTCCTTCAACTGCGGTGGCGAGTTCTTCTACTGCAACAC
GTCGAACCTGTTCAACAGCACGTACAACGACACCTACATCTCCACGAACTCGTCCGCGAACAACTCCTCGACGATCACGCTC
CAGTGCCGCATCAAGCAGATCATCAACATGTGGCAGGGGGTGGGCCGCGCTATGTACGCACCGCCCATCGCCGGCAACATCA
CCTGCAAGTCCAACATCACCGGCCTCCTGCTGACCCGCGACGGCGGCACGGACTCGAACGAGACGGAGACCTTCAGGCCAGC
GGGAGGCGACATGCGCGACAACTGGCGCTCCGAGCTGTACAAGTACAAGGTGGTGGAGATCCAGCCCCTGGGCATCGCACCC
ACCGGGGCCAAGgagCGGGTCGTGGAGCGCGAGAAGgagGCGGTGGGCCTCGGCGCCCTGTTCCTGGGCTTCCTGGGCGCTG
CGGGCTCCACCATGGGTGCCGCGTCCATCACCCTGACCGTGCAGGCCCGCCAGCTGCTCTCCGGCATCGTGCAGCAGCAGTC
CAACCTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACCAACG
TGCCCTGGAACACGTCCTGGTCCAACAAGTCGGAGACCGACATCTGGGACAACATGACCTGGATGCAGTGGGAGCGCGAGAT
CTCCAACTACACCGGGACCCATCTACAAGCTCCTCGAGGACTCCCAGAACCAGCAGGAGCGGAACGAGCAGGATCTGCTCGCG
CTGGACTCGTGGAACAACCTGTGGTCGTGGTTCTCCATCACCAAGTGGCTGTGGTACATCAAgTAGTgAGaattcggtgacc
gggacctggatcc
>HV1300872_CH848.3.d1305.10.21gp140C
GgtcgacaagaaGCCACCATGCGCGTGACGGGCATCCTCAAGAACTACCCGCGCTGGTGGATCTGGGGCATCCTGGGCTTCT
GGATGCTCATGATCTGCAACggcAAGGGCAAGCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCAGCCCGCAGGAGCTCGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCACGGTGGAGAACTCGACGACGGAGGAGATGAAGAACTGCTCCTTCAACACGACGACGGAGATCCGCGACAAGGAG
AAGAAGGAGCACGCCCTGTTCTACCGCCCGGACATCGTGCCGCTGAACAACGAGACGGGCAACACGTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAAGGTGTCCACCGTGCAGTGCACG
CACGGCATCCGGCCCGTGGTGTCCACGCAGCTGCTCCTGAACGGGTCGCTGGCGGAGAAGGGGATCGTCATCCGGTCCGAGA
ACCTCACGAACAACGCGAAGATCATCATCGTGCAGCTGAACACGTCGGTGGAGATCGTGTGCACCCGCCCGAACAACAACAC
GCGCAAGTCCGTCCGGATCGGCCCTGGCCAGACCTTCTACGCCACCGGCGACATCATCGGCAACATCCGGCAGGCCCACTGC
AACATCAGCGAGTCGAAGTGGAACGACACCCTGCAGAAGGTGGGCATCGAGCTGCAGAAGCACTTCCCCAACAAGACCATCA
AGTACAACCAGTCGGCCGGCGGCGACATGGAGATCACCACGCACTCCTTCAACTGCGGTGGCGAGTTCTTCTACTGCAACAC
GGCGAAGCTGTTCAACAGCACGTACAACGGCACCTACATCTCCACGAACTCGACGAACTCGACGTCCAAGAACATCACGCTC
CAGTGCCGCATCAAGCAGATCATCAACATGTGGCAGGGGGTGGGCCGCGCTATGTACGCACCGCCCATCGCCGGCAACATCA
CCTGCCGCTCCAACATCACCGGCCTCCTGCTGACCCGCGACGGCGGCACGACGAACAACTCGAACGAGACGGAGACCTTCAG
GCCAGCGGGAGGCGACATGCGCGACAACTGGCGCTCCGAGCTGTACAAGTACAAGGTGGTGGAGGTCCAGCCCCTGGGCATC
GCACCCACCGGGGCCAAGgagCGGGTCGTGGAGCGCGAGAAGgagGCGGCCGGCCTCGGCGCCCTGTTCCTGGGCTTCCTGG
GCGCTGCGGGCTCCACCATGGGTGCCGCGTCCATCACCCTGACCGTGCAGGCCCGCCAGCTGCTCTCCGGCATCGTGCAGCA
GCAGTCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATCTGGGGCTGCTCCGGCAAGCTGATCTGCACGA
CCAACGTGCCCTGGAACACGTCCTGGTCCAACAAGTCGGAGACCGACATCTGGGGCAACATGACCTGGATGCAGTGGGAGCG
CGAGATCTCCAACTACACCGAGACCATCTACAAGCTCCTCGAGGACTCCCAGAACCAGCAGGAGCGGAACGAGCAGGATCTG
```

Figure 7 continued

CTCGCGCTGGACTCGTGGAACTCGCTGTGGTCGTGGTTCAACATCACCAAGTGGCTGTGGTACATCAAgTAGTgAGaattcg
gtgaccgggtcctggatcc
>HV1300873_CH848.3.d1305.10.30gp140C
GgtcgacaagaaGCCACCATGCGCGTGACGGGCATCCTCAAGAACTACCCGCAGTGGTGGATCTGGGGCATCCTGGGCTTCT
GGATGCTCATGACGTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GACCGCCACGGTGAACAACTCGACGGTGGACGAGATGAAGAACTGCTCCTTCAACGCGACGACGGAGATCCGCGACAAGAAG
AAGAAGGAGTACGCCCTGTTCTACCGCTCCGACGTCGTGCCGCTGGACGAGACGAACAACACGTCGGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACGACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGCACACGCCGGTGGAGATCGTGTGCACCCGCCCGGGGCACAACACGCG
CAAGTCCGTCCGGATCGGCCCTGGCCAGACCTTCTACGCCACCGGCGACATCATCGGCGACATCCGGCAGGCCCACTGCAAC
ATCAACGAGTCGGAGTGGAACGAGACCCTGCAGAAGGTGGGCAAGGAGCTGCAGAAGCACTTCCCCAACAAGACCATCAAGT
ACGAGCAGTCGGCCGGCGGCGACATGGAGATCACCACGCACTCCTTCAACTGCGGTGGCGAGTTCTTCTACTGCAACACGGC
GGAGCTGTTCAACGGCACGTACAACGGCACCGACATCTCCACGAACTCGTCGGCGAACTCCACGTCCACGATCACGCTCCAG
TGCCGCATCAAGCAGATCATCAACATGTGGCAGGGGGTGGGCCGCGCTATGTACGCACCGCCCATCGCCGGCAACATCACCT
GCCGCTCCAACATCACCGGCCTCCTGCTGACCCGCGACGGCGGCATCAACAACGTCTCGAACGAGACGGAGACCTTCAGGCC
AGCGGGAGGCGACATGCGCGACAACTGGCGCTCCGAGCTGTACAAGTACAAGGTGGTGGAGGTCCAGCCCCTGGGCATCGCA
CCCACCGGGGCCAAGgagCGGGTCGTGGAGCGCGAGAAGgagGCGGCCGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGATGGACATCTGGAACAACATGACCTGGATGCAGTGGGAGCGCGA
GATCTCCAACTACACCGAGACCATCTACATGCTCCTCGAGGACTCCCAGCGGCAGCAGGAGCGGAACGAGAAGGATCTGCTC
GCGCTGGACTCGTGGAACTCGCTGTGGAACTGGTTCAACATCACCAACTGGCTGTGGTACATCAAgTAGTgAGaattcggtc
accgggtcccggatcc
>HV1300874_CH848.3.d1305.10.35gp140C
GgtcgacaagaaGCCACCATGCGCGTGACGGGCATCCGGAAGAACTGCCCGCAGTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GACCGCCACGGTGAACAACTCGAAGTTCGAGGAGATGAAGAACTGCTCCTTCAACCACCACGGAGATCCGCGACAAGGAG
AAGAAGGAGTACGCCCTGTTCTACCGCCCCGACATCGTGCCGCTGGACAACGAGACGTCCAACATCTCGGAGTACAGGCTGA
TCAACTGCAACACCTCCGCGGTCACGCAGGCGTGCCCCAAGGTCACGTTCGAGCCCATCCCCATCCACTACTGCGCCCCCGC
CGGCTACGCCATCCTGAAGTGCAACGACGAGACCTTCAACGGGACCGGCCCGTGCAGCAACGTGTCCACCGTGCAGTGCACG
CACGGCATCCGGCCCGTGGTGTCCACGCAGCTGCTCCTGAACGGGTCGCTGGCGGAGAAGGAGATCGTCATCCGGTCCGAGA
ACCTCACGAACAACGCGAAGATCATCATCGTGCACCTGCACACGCCGGTGGAGATCGTGTGCACCCGCCCGAACAACAACAC
GCGCAAGTCCGTCCGGATCGGCCCTGGCCAGACCTTCTACGCCACCGGCGACATCATCGGCAACCCGCGGCAGGCCCACTGC
AACATCTCGAAGGAGCGGTGGAACGACACCCTGCAGAAGGTGGGCAAGGAGCTGCAGAAGCACTTCCCCAACAAGACCATCA
AGTACAACCAGTCGGCCGGCGGCGACATGGAGATCACCACGCACTCCTTCAACTGCGGTGGCGAGTTCTTCTACTGCAACAC
GTCCAACCTGTTCAACTCGACGTACAACGACACCTACATCTCCACGAACTCGACCAACTCCACGTCCTACATCACGCTCCAG
TGCCGCATCAAGCAGATCATCAACATGTGGCAGGGGGTGGGCCGCGCTATGTACGCACCGCCCATCGCCGGCAACATCACCT
GCAAGTCCAACATCACCGGCCTCCTGCTGACCCGCGACGGCGGCATCAACAAGGACTCGAACGAGACGGAGACCTTCAGGCC
AGCGGGAGGCGACATGCGCGACAACTGGCGCTCCGAGCTGTACAAGTACAAGGTGGTGGAGGTCCAGCCCCTGGGCATCGCA
CCCACCGGGGCCAAGgagCGGGTCGTGGAGCGCGAGAAGgagGCGGCCGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGACGGACATCTGGACAACATGACCTGGATGCAGTGGGAGCGCGA
GATCTCCAACTACACCGGGACCATCTACAAGCTCCTCGAGGACTCCCAGAACCAGCAGGAGCGGAACGAGCAGGATCTGCTC

Figure 7 continued

GCGCTGGACTCGTGGAACTCGCTGTGGAACTGGTTCTCCATCACCAAGTGGCTGTGGTACATCAAgTAGTgAGaattcggtc
accaggacccggatcc
>HV1300875_CH848.3.d1432.5.18gp140C
GgtcgacaagaaGCCACCATGCGCGTGACGGGCATCCTGAAGAACTGCCCGCTGTGGTGGATCTGGGGCATCCTGGGCTTCT
GGATGCTCATGAACTGCAACggcGAGGGCAAGCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTGAAGAACTCCACCACCGAGGAGATGAGCAACGCCACCGTCAAGAACAGCACCACGGAGGAGATGTCCAAC
GCCACGGTGAAGAACTCGACGACAGAGGAGATGAAGAACTGCTCCTTCAACACCACGACGGAGATCCGCGACAAGGAGAAGA
AGGAGTACGCCCTGTTCTACCGCCCCGACGTCGTGCCGCTGGACGAGACGAACAACACCTCGAAGTACAGGCTGATCAACTG
CAACACCTCCGCGGTCACGCAGGCGTGCCCCAAGGTCACGTTCGAGCCCATCCCCATCCACTACTGCGCCCCCGCCGGCTAC
GCCATCCTGAAGTGCAACGACGAGACCTTCAACGGGACCGGCCCGTGCAGCAAGGTGTCCACCGTGCAGTGCACGCACGGCA
TCCGGCCCGTGGTGTCCACGCAGCTGCTCCTGAACGGGTCGCTGGCGGAGAAGGGAGATCGTCATCCGGTCCGAGAACCTCAC
GAACAACGCGAAGATCATCATCGTGCACCTGCACACGCCGGTGGAGATCGTGTGCACCCGCCCGTACAACAACACGCGCAAG
TCCGTCCGGATCGGCCCTGGCCAGACCTTCTACGCCACCGGCGACATCATCGGCGACCCGCGGCAGGCCCACTGCAACATCT
CGAAGGAGATCTGGAACAAGACCCTGCAGGAGGTGGGCAAGGAGCTGCAGAAGCACTTCCCCAACAAGACCATCCGGTACAA
CCAGTCGGCCGGCGGCGACATGGAGATCACCACGCACTCCTTCAACTGCGGTGGCGAGTTCTTCTACTGCAACACGTCCAAC
CTGTTCAACTCGACGTACAACGACACCTACATCTCCCCGAACTCGACCAACTCCACGTCCACCATCACGCTCCAGTGCCGCA
TCAAGCAGATCATCAACATGTGGCAGGGGGTGGGCCGCGCTATGTACGCACCGCCCATCGCCGGCAACATCACCTGCAAGTC
CAACATCACCGGCCTCCTGCTGACCCGCGACGGCGGCATCAACAACGTGTCGAACGAGACGGAGACCTTCAGGCCAGCGGGA
GGCGACATGCGCGACAACTGGCGCTCCGAGCTGTACAAGTACAAGGTGGTGGAGGTCCAGCCCCTGGGCCTCGCACCCACCG
GGGCCAAGgagCGGGTCGTGGAGCGCGAGAAGgagGCGGCCGGCCTCGGCGCCCTGTTCCTGGGCTTCCTGGGCGCTGCGGG
CTCCACCATGGGTGCCGCGTCCATCACCCTGACCGTGCAGGCCCGCCAGCTGCTCTCCGGCATCGTGCAGCAGCAGTCCAAC
CTCCTGAGGGCCATCGAGGCCCAGCAGCACATGCTGCAGCTGACCGTGTGGGGCATCAAGCAGCTGCAGGCCAGGGTGCTCG
CGCTCGAGCGCTACCTGAAGGACCAGCAGCTGCTCGGCATGTGGGGCTGCTCCGGCAAGCTGATCTGCACGACCAACGTGCC
CTGGAACACGTCCTGGTCCAACAAGTCGGAGACGGACATCTGGGACAACATGACCTGGATGCAGTGGGAGCGCGAGATCTCC
AACTACACCGGGACCATCTACAAGCTCCTCGAGGACTCCCAGAACCAGCAGGAGCGGAACGAGCAGGATCTGCTCGCGCTGG
ACTCGTGGAACTCGCTGTGGAACTGGTTCTCCATCACCAAGTGGCTGTGGTACATCAAgTAGTgAGaattcggtcaccaggt
cccggatcc
>HV1300876_CH848.3.d1432.5.27gp140C
GgtcgacaagaaGCCACCATGCGCGTGACGGGCATCCTGAAGAACTACCCGCGCTGGTGGATCTGGGGCATCCTGGGCTTCT
GGATGCTCATGAACTGCAACggcGAGGGCAAGCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCACGGTGAACAACACCACCGACTACGACTCCAGGAGCAACGCCAACGTCACCAACATCACCAACACCATCAAGGAG
GAGGTGAAGAACTGCTCCTTCAAGACCACGACGGAGATCCGCGACAAGGAGAAGAAGGAGCACGCCCTGTTCTACCGCCCCG
ACATCGTGCCGCTGAACTCGGAGACGGGGAACACCTCGGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAAGGTGTCCACCGTGCAGTGCACGCACGGCATCCGGCCCGTGGTGTCCACGCAGC
TGCTCCTGAACGGGTCGCTGGCGGAGAAGGGGATCGTCATCCGGTCCGAGAACCTCACGAACAACGCGAAGATCATCATCGT
GCAGCTGAACACGTCGGTGGAGATCGTGTGCACCCGCCCGGGCAACAACACGCGCAAGTCCATGCGGATCGGCCCTGGCCAG
ACCTTCTACGCCACCGGCGACATCATCGGCGACATCCGGCAGGCCCACTGCAACATCTCGGAGTCGAAGTGGAACGACACCC
TGCAGAAGGTGGGCATCGAGCTGCAGAAGCACTTCCCCAACAAGACCATCAAGTACAACCAGTCGGCCGGCGGCGACATGGA
GATCACCACGCACTCCTTCAACTGCGGTGGCGAGTTCTTCTACTGCAACACGGCCAAGCTGTTCAACTCGACGTACAACGGC
ACCTACATCTCCACGGAACTCGTCCGCCAACTCCACGTCCAAGAACATCACGCTCCAGTGCCGCATCAAGCAGATCATCAACA
TGTGGCAGGGGGTGGGCCGCGCTATGTACGCACCGCCCATCGCCGGCAACATCACCTGCCGGTCCAACATCACCGGCCTCCT
GCTGACCCGCGACGGCGGCATCCACAACGACTCGAACGAGACGGAGACCTTCAGGCCAGCGGGAGGCGACATGCGCGACAAC
TGGCGCTCCGAGCTGTACAAGTACAAGGTGGTGGAGATCCAGCCCCTGGGCATCGCACCCACCGGGGCCAAGgagCGGGTCG
TGGGGCGCGAGAAGgagGCGGCCGGCCTCGGCGCCCTGTTCCTGGGCTTCCTGGGCGCTGCGGGCTCCACCATGGGTGCCGC
GTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGA
AGGACCAGCAGCTGCTCGGCATCTGGGGCTGCTCCGGCAAGCTGATCTGCACGACCAACGTGCCCTGGAACACGTCCTGGTC
CAACAAGTCGGAGACGGACATCTGGGAGAACATGACCTGGATGCAGTGGGAGCGCGAGATCTCCAACTACACCGAGACCATC

Figure 7 continued

```
TACAAGCTCCTCGAGGACTCCCAGAACCAGCAGGAGCGGAACGAGCAGGATCTGCTCGCGCTGGACTCGTGGAACTCGCTGT
GGAACTGGTTCTCCATCACCAAGTGGCTGTGGTACATCAAgTAGTgAGaattcggtcaccgggacctggatcc
>HV1300877_CH848.3.d1432.5.41gp140C
GgtcgacaagaaGCCACCATGCGCGTGACGGGCATCCTGCGGAACTACCCGCAGTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCGACCACGGAGGAGATGTCCACCGCCCTCGTGAAGAACTCCACGACCGAGGCGATGAAGAAC
TGCTCCTTCAACACCACGACGGAGATCCGCGACAAGGAGAAGAAGGAGTACGCCCTGTTCTACCGCCCCGACATCGTGCCGC
TGAACAACGAGACGGGGAACATCTCCGAGTACAGGCTGATCAACTGCAACACCTCCGCGGTCACGCAGGCGTGCCCCAAGGT
CACGTTCGAGCCCATCCCCATCCACTACTGCGCCCCCGCCGGCTACGCCATCCTGAAGTGCAACGACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGAAGGAGGAGATCGTCATCCGGTCCGAGAACCTCACGAACAACGCGAAGATCATCATCGTGCACCTGCACAC
GCCGGTGGAGATCGTGTGCACCCGCCCGAACAACAACACGCGCAAGTCCGTGCGGATCGGCCCTGGCCAGACCTTCTACGCC
ACCGGCGACATCATCGGCGACCCGCGGAAGGCCCACTGCAACATCTCGGAGAAGGACTGGAACAAGACCCTGCAGGAGGTGG
GCAAGGAGCTGCAGAAGCACTTCCCCAACAAGACCATCCGGTACAACCAGTCGGCCGGCGGCGACATGGAGATCACCACGCA
CTCCTTCAACTGCGGTGGCGAGTTCTTCTACTGCAACACGTCGAAGCTGTTCAACTCGACGTACAACGACACCTACATCTCC
ACGAACTCGTCCGCCAACAACTCGTCCACGATCACGCTCCAGTGCCGCATCAAGCAGATCATCAACATGTGGCAGGGGGTGG
GCCGCGCTATGTACGCACCGCCCATCGCCGGCAACATCACCTGCAAGTCCAACATCACCGGCCTCCTGCTGACCCGCGACGG
CGGCCCGGACTCGAACGAGACGGAGACCTTCAGGCCAGCGGGAGGCGACATGCGCGACAACTGGCGCTCCGAGCTGTACAAG
TACAAGGTGGTGGAGGTCCAGCCCCTGGGCATCGCACCCACCGGGGCCAAGgagCGGGTCGTGGAGCGCGAGAAGgagGCGG
CCGGCCTCGGCGCCCTGTTCCTGGGCTTCCTGGGCGCTGCGGGCTCCACCATGGGTGCCGCGTCCATCACCCTGACCGTGCA
GGCCCGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTCGGCA
TCTGGGGCTGCTCCGGCAAGCTGATCTGCACGACCAACGTGCCCTGGAACACGTCCTGGTCCAACAAGTCGGAGACGGACAT
CTGGGGGAACATGACCTGGATGCAGTGGGAGCGCGAGATCTCCAACTACACCGAGACCATCTACAAGCTCCTCGAGGACTCC
CAGAACCAGCAGGAGCGGAACGAGCAGAACCTGCTCGCGCTGGACTCGTGGAACTCGCTGTGGAACTGGTTCTCCATCACCA
AGTGGCTGTGGTACATCAAgTAGTgAGaattcggtcaccgggtcctggatcc
>HV1300878_CH848.3.d1432.5.50gp140C
GgtcgacaagaaGCCACCATGCGCGTGACGGGCATCCTGAAGAACTACCCGCAGTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GACCGCCACGGTGAACAACTCCACGGTGGACGAGATGAAGAACTGCTCCTTCAACGCCACGACGGAGATCCGCGACAAGAAG
AAGAAGGAGTACGCCCTGTTCTACCGCTCGGACGTCGTGCCGCTGGACGAGACGAACAACACGTCCGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACGACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGATCATCATCGTGCACCTGCACGCCGGTGGAGATCGTGTGCACCCGCCCGGGCCACAACACGCG
CAAGTCCGTGCGGATCGGCCCTGGCCAGACCTTCTACGCCACCGGCGACATCATCGGCGACATCCGGCAGGCCCACTGCAAC
ATCAACGAGTCGAAGTGGAACGAGACCCTGCAGAAGGTGGGCAACGAGCTGCAGAAGCACTTCCCCAACAAGACCATCAAGT
ACGAGCAGGCGGCCGGCGGCGACATGGAGATCACCACGCACTCCTTCAACTGCGGTGGCGAGTTCTTCTACTGCAACACGGC
CAACCTGTTCAACGGCACGTACAACGGGACCGACATCTCCACGAACTCGTCCGCCAACTCGACGTCCACGATCACGCTCCAG
TGCAAGATCAAGCAGATCATCAACATGTGGCAGGGGGTGGGCCGCGCTATGTACGCACCGCCCATCGCCGGCAACATCACCT
GCCGCTCCAACATCACCGGCCTCCTGCTGACCCGCGACGGCGGCATCAACAACGTGTCGAACGAGACGGAGACCTTCAGGCC
AGCGGGAGGCGACATGCGCGACAACTGGCGCTCCGAGCTGTACAAGTACAAGGTGGTGGAGGTCCAGCCCCTGGGCATCGCA
CCCACCGGGGCCAAGgagCGGGTCGTGGAGCGCGAGAAGgagGCGGCCGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGATGGACATCTGGAACAACATGACCTGGATGCAGTGGGAGCGCGA
GATCTCCAACTACACCGAGACCATCTACATGCTCCTCGAGGACTCCCAGCGCCAGCAGGAGCGGAACGAGAAAGACCTGCTC
```

Figure 7 continued

```
GCGCTGGACTCGTGGAACTCGCTGTGGAACTGGTTCAACATCACCAACTGGCTGTGGTACATCAAgTAGTgAGaattcggta
accgggtcccggatcc
>HV1300879_CH848.3.d1432.5.56gp140C
GgtcgacaagaaGCCACCATGCGCGTGACGGGCATCCTGAAGAACTACCCGCGGTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCGACCACCGAGGAGATGTCCAACGCCACGGTGAAGAACTCCACGACGGAGGAGATGAAGAAC
TGCTCCTTCAACACCACGACGGAGATCCGCGACAAGGAGAAGAAGGAGTACGCCCTGTTCTACCGCCCCGACGTCGTGCCGC
TGGACGAGACGAACAACACGTCCAAGTACAGGCTGATCAACTGCAACACCTCCGCGGTCACGCAGGCGTGCCCCAAGGTCAC
GTTCGAGCCCATCCCCATCCACTACTGCGCCCCGCCGGCTACGCCATCCTGAAGTGCAACGACGAGACCTTCAACGGGACC
GGCCCGTGCAGCAACGTGTCCACCGTGCAGTGCACGCACGGCATCCGGCCCGTGGTGTCCACGCAGCTGCTCCTGAACGGGT
CGCTGGCGGAGAAGGAGATCGTCATCCGGTCCGAGAACCTCACGAACAACGCGAAGATCATCATCGTGCACCTGCACACGCC
GGTGGAGATCGTGTGCACCCGCCCGTACAACAACACGCGCAAGTCCGTGCGGATCGGCCCTGGCCAGACCTTCTACGCCACC
GGCGACATCATCGGCGACCCGCGGCAGGCCCACTGCAACATCTCGAAGGAGATCTGGAACAAGACCCTGCAGGAGGTGGGCA
AGGAGCTGCAGAAGCACTTCCCCAACAAGACCATCCGCTACAACCAGTCCGCCGGCGGCGACATGGAGATCACCACGCACTC
CTTCAACTGCGGTGGCGAGTTCTTCTACTGCAACACGGCCAAGCTGTTCAACTCCACGTACAACGACACCTACAAGTCCACG
AACTCGTCCGCCAACAACTCGTCCATCATCACGCTCCAGTGCCGGATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CATCAACAACGTGTCGAACGAGACGGAGACCTTCAGGCCAGCGGGAGGCGACAACTGGCGCTCCGAGCTGTACAAGTACAAG
GTGGTGGAGGTCCAGCCCCTGGGCATCGCACCCACCGGGGCCAAGgagCGGGTCGTGGAGCGCGAGAAGgagGCGGTGGGCC
TCGGCGCCCTGTTCCTGGGCTTCCTGGGCGCTGCGGGCTCCACCATGGGTGCCGCGTCCATCACCCTGACCGTGCAGGCCCG
CCAGCTGCTCTCCGGCATCGTGCAGCAGCAGTCCAACCTCCTGAGGGCCATCGAGGCCCAGCAGCACATGCTGCAGCTGACC
GTGTGGGGCATCAAGCAGCTGCAGGCCAGGGTGCTCGCGCTCGAGCGCTACCTGAAGGACCAGCAGCTGCTCGGCATGTGGG
GCTGCTCCGGCAAGCTGATCTGCACGACCAACGTGCCCTGGAACACGTCCTGGTCCAACAAGTCGGAGACCGACATCTGGGA
CAACATGACCTGGATGCAGTGGGAGCGCGAGATCTCCAACTACACCGGGACCATCTACAAGCTCCTCGAGGACTCCCAGAAC
CAGCAGGAGCGGAACGAGCAAGACCTGCTCGCGCTGGACTCGTGGAACTCGCTGTGGAACTGGTTCTCCATCACCAAGTGGC
TGTGGTACATCAAgTAGTgAGaattcggtaaccaggacccggatcc
>HV1300880_CH848.3.d1621.4.12gp140C
GgtcgacaagaaGCCACCATGCGCGTGACGGGCATCCTGAAGAACTACCCGCGGTGGTGGATCTGGGGCATCCTGGGCTTCT
GGATGCTCATGAACTGCAACggcGAGGGCAAGCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCAGCCCGCAGGAGCTCTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCACGGTCAACTCCACCACCGACTACGACTCCCGGTCCAACGACACCGTGACCAACATCACGAACACGATCAAGGAG
GAGGTGAAGAACTGCTCCTTCAAGACCACGACGGAGATCCGCGACAAGGAGAAGAAGGAGCACGCCCTGTTCTACCGCCCCG
ACATCGTGCCGCTGAACTCCGAGACGGGCAACACGTCCGAGTACAGGCTGATCAACTGCAACACCTCCGCGGTCACGCAGGC
GTGCCCCAAGGTCACGTTCGAGCCCATCCCCATCCACTACTGCGCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGC
TGCTCCTGAACGGGTCGCTGGCGAAGGAGGAGATCGTCATCCGGTCCGAGAACCTCACGAACAACGCGAAGACCATCATCGT
GCACCTGCACACGCCGGTGGAGATCGTGTGCACCCGCCCGGGCAACAACACGCGCAAGTCCATGCGGATCGGCCCTGGCCAG
ACCTTCTACGCCACCGGCGACATCATCGGCGACATCCGGCAGGCCCACTGCAACATCTCGGAGGAGAAGTGGAACAAGACCC
TGCAGGAGGTGGGCAAGGAGCTGCAGAAGCACTTCCCCAACCGGACCATCAAGTACAACCAGTCCGCCGGCGGCGACATGGA
GATCACCACGCACTCCTTCAACTGCGGTGGCGAGTTCTTCTACTGCAACACGTCCAAGCTGTTCAACTCCACGTACAACGAC
ACCTACATCTCCACGAACTCGACCAACTCGTCCGCCAACAACTCGTCCATCATCACGCTCCAGTGCCGGATCAAGCAGATCA
TCAACATGTGGCAGGGGGTGGGCCGCGCTATGTACGCACCGCCCATCGCCGGCAACATCATCTGCAAGTCCAACATCACCGG
CCTCCTGCTGACCCGCGACGGCGGCCGGACTCGAACAAGACGGAGACCTTCAGGCCAGCGGGAGGCGACATGCGGGACAAC
TGGCGCTCCGAGCTGTACAAGTACAAGGTGGTGGAGGTCCAGCCCCTGGGCATCGCACCCACCGGGGCCAAGgagCGGGTCG
TGGAGCGCGAGAAGgagGCGGCCGGCCTCGGCGCCCTGTTCCTGGGCTTCCTGGGCGCTGCGGGCTCCACCATGGGTGCCGC
GTCCATCACCCTGACCGTGCAGGCCCGCCAGCTGCTCTCCGGCATCGTGCAGCAGCAGTCCAACCTCCTGAGGGCCATCGAG
GCCCAGCAGCACATGCTGCAGCTGACCGTGTGGGGCATCAAGCAGCTGCAGGCCAGGGTGCTCGCGCTCGAGCGCTACCTGA
AGGACCAGCAGCTGCTCGGCATCTGGGGCTGCTCCGGCAAGCTGATCTGCACGACCAACGTGCCCTGGAACACGTCCTGGTC
CAACAAGTCGGAGACCGACATCTGGGCAACATGACCTGGATGCAGTGGGAGCGCGAGATCTCCAACTACACCGAGACCATC
```

Figure 7 continued

```
TACAAGCTCCTCGAGGACTCCCAGAACCAGCAGGAGCGGAACGAGCAAGACCTGCTCGCGCTGGACTCGTGGAACTCGCTGT
GGTCGTGGTTCAACATCACCAAGTGGCTGTGGTACATCAAgTAGTgAGaattcggtaaccaggtcccggatcc
>HV1300881_CH848.3.d1621.4.15gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCAACCCGCAGGAGATGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCACGGTCAACTCCACCACCGACTACGACTCCCGGTCCAACGACTCCGTGACCAACATCACGAACACGATCAAGGAG
GAGGTGAAGAACTGCTCCTTCAAGACCACGACGGAGATCCGCGACAAGGAGAAGAAGGAGCACGCCCTGTTCTACCGCCCCG
ACATCGTGCCGCTCAACTCCGAGACGGGCAACATCTCCGAGTACAGGCTGATCAACTGCAACACCTCCGCGGTCACGCAGGC
GTGCCCCAAGGTCACGTTCGAGCCCATCCCCATCCACTACTGCGCCCCCGCCGGCTACGCCATCCTGAAGTGCAACGACGAG
ACCTTCAACGGGACCGGCCCGTGCAGCAACGTGTCCACCGTGCAGTGCACGCACGGCATCCGGCCCGTGGTGTCCACGCAGC
TGCTCCTGAACGGGTCGCTGGCGAAGGAGGAGATCGTCATCCGGTCCGAGAACCTCACGAACAACGCGAAGATCATCATCGT
GCAGCTGAACACGTCCGTGGAGATCGTGTGCACCCGCCCGGGCAACAACACGCGCAAGTCCGTGCGGATCGGCCCTGGCCAG
ACCTTCTACGCCACCGGCGACATCATCGGCGACATCCGGCAGGCCCACTGCAACATCTCGGAGAAGAAGTGGAACGAGACCC
TGCAGCGGGTGGGCATCGAGCTGCAGAAGCACTTCCCCAACAAGACCATCAAGTACAACCAGTCCGCCGGCGGCGACATGGA
GATCACCACGCACTCCTTCAACTGCGGTGGCGAGTTCTTCTACTGCAACACGGCCAAGCTGTTCAACTCCACGTACAACGGC
ACCTACATCAACACGACCTCGATCAACTCGACCCTCAACATCACGCTCCAGTGCCGGATCAAGCAGATCATCAACATGTGGC
AGGGGGTGGGCCGCGCTATGTACGCACCGCCCATCGCCGGCAACATCACCTGCCGGTCCAACATCACCGGCCTCCTGCTGAC
CCGCGACGGCGGCATCCACAACGACTCGAACGAGACGGAGACCTTCAGGCCAGCGGGAGGCGACATGCGGGACAACTGGCGC
TCCGAGCTGTACAAGTACAAGGTGGTGGAGGTCCAGCCCCTGGGCATCGCACCCACCGGGGCCAAGgagCGGGTCGTGGAGC
GCGAGAAGGagGCGGCCGGCCTCGGCGCCCTGTTCCTGGGCTTCCTGGGCGCTGCGGGCTCCACCATGGGTGCCGCGTCCAT
CACCCTGACCGTGCAGGCCCGCCAGCTGCTCTCCGGCATCGTGCAGCAGCAGTCCAACCTCCTGAGGGCCATCGAGGCCCAG
CAGCACATGCTGCAGCTGACCGTGTGGGGCATCAAGCAGCTGCAGGCCAGGGTGCTCGCGCTCGAGCGCTACCTGAAGGACC
AGCAGCTGCTCGGCATCTGGGGCTGCTCCGGCAAGCTGATCTGCACGACCAACGTGCCCTGGAACACGTCCTGGTCCAACAA
GTCGGAGACCGACATCTGGGGCAACATGACCTGGATGCAGTGGGAGCGCGAGATCTCCAACTACACCGAGACCATCTACAAG
CTCCTCGAGGACTCCCAGAACCAGCAGGAGCGGAACGAGCAAGACCTGCTCGCGCTGGACTCGTGGAACTCGCTGTGGTCGT
GGTTCAACATCACCAAGTGGCTGTGGTACATCAAgTAGTgAGaattcggtaaccgggacctggatcc
>HV1300882_CH848.3.d1621.4.25gp140C
GgtcgacaagaaGCCACCATGCGCGTGACGGGCATCCTGAAGAACTACCCGCAGTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACGAGAAGGAGGTGCACAACGTGTGGGCGACCCACGCCTGCGTGCCCACG
GACCCCAGCCCGCAGGAGCTCTTCCTGGAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GACCGCCACGGTGAACAACTCCACGGTGGACGAGATGAAGAACTGCTCCTTCAACGCCACGACGGAGATCCGCGACAAGAAG
AAGAAGGAGTACGCCCTGTTCTACCGCTCGGACGTCGTGTCCCTGGACGAGACGAACAACACGTCCGAGTACAGGCTGATCA
ACTGCAACACCTCCGCGGTCACGCAGGCGTGCCCCAAGGTCACGTTCGAGCCCATCCCCATCCACTACTGCGCCCCCGCCGG
CTACGCCATCCTGAAGTGCAACGACGAGACCTTCAACGGGACCGGCCCGTGCAGCAACGTGTCCACCGTGCAGTGCACGCAC
GGCATCCGGCCCGTGGTGTCCACGCAGCTGCTCCTGAACGGGTCGCTGGCGGAGAAGGAGATCGTCATCCGGTCCGAGAACC
TCACGAACAACGCGAAGACGATCATCGTGCACCTGCACGCCCCGGTGGAGATCGTGTGCACCCGCCCGGGCCACAACACGCG
CAAGTCCGTGCGGATCGGCCCTGGCCAGACCTTCTACGCCACCGGCGACATCATCGGCAACATCCGGCAGGCCCACTGCAAC
ATCAACGAGTCGGAGTGGAACGAGACCCTGCAGAAGGTGGGCAAGGAGCTGCGCAAGCACTTCCCCAACAAGACCATCAAGT
ACGAGCAGTCCGCCGGCGGCGACATGGAGATCACCACGCACTCCTTCAACTGCGGTGGCGAGTTCTTCTACTGCAACACGGC
CAACCTGTTCAACGGCACGTACAACGGGACCGACATCTCCACGAACTCGTCCGCCGACCGCAACTCCACGATCACGCTCGAG
TGCAAGATCAAGCAGATCATCAACATGTGGCAGGGGGTGGGCCGCGCTATGTACGCACCGCCCATCGCCGGCAACATCACCT
GCCGCTCCAACATCACCGGCCTCCTGCTGACCCGCGACGGCGGCATCAACAACGTGTCAACCGGAGACCTTCAGGCC
AGCGGGAGGCGACATGCGCGACAACTGGCGCTCCGAGCTGTACAAGTACAAGGTGGTGGAGGTCCAGCCCCTGGGCATCGCA
CCCACCGGGGCCAAGgagCGGGTCGTGGAGCGCGAGAAGgagGCGGTGGGCCTCGGCGCCCTGTTCCTGGGCTTCCTGGGCG
CTGCGGGCTCCACCATGGGTGCCGCGTCCATCACCCTGACCGTGCAGGCCCGCCAGCTGCTCTCCGGCATCGTGCAGCAGCA
GTCCAACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACGACCA
ACGTGCCCTGGAACACGTCCTGGTCCAACAAGTCGGAGATGGACATCTGGAACAACATGACCTGGATGCAGTGGGAGCGCGA
GATCTCCAACTACACCGAGACCATCTACATGCTCCTCGAGGACTCCCAGCGCCAGCAGGAGCGGAACGAGAAAGACCTGCTC
```

Figure 7 continued

```
GCGCTGGACTCGTGGAACTCGCTGTGGAACTGGTTCAACATCACCAACTGGCTGTGGTACATCAAgTAGTgAGaattcggta
accgggtcctggatcc
>HV1300883_CH848.3.d1621.4.31gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCAACGCCACCGTCGAGAACTCCACGGAGGCCATGAAGAACTGCTCCTTCAACACCACGACG
GAGATCCGCGACAAGATCAAGAAGGAGCGGGCCCTGTTCTACCGCCCCGACATCGTGCCGCTCAACGACGAGACGAACAACA
CCTCCAAGTACAGGCTGATCAACTGCAACACCTCCGCGGTCACGCAGGCGTGCCCCAAGGTCACGTTCGAGCCCATCCCCAT
CCACTACTGCGCCCCGCCGGCTACGCCATCCTGAAGTGCAACGACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCGGAGAAGGAGA
TCGTCATCCGGTCCGAGAACCTCACGAACAACGCGAAGATCATCATCGTGCACCTGCACACGCCGGTGCAGATCGTGTGCAC
CCGCCCGTACAACAACACGCGCAAGTCCGTGCGGATCGGCCCTGGCCAGACCTTCTACGCCACCGGCGACATCATCGGCGAC
CCGCGGAAGGCCCACTGCAACATCTCGGAGAAGGACTGGAACAAGACCCTGCAGGAGGTGGGCAAGGAGCTGCAGAAGCACT
TCCCCAACAAGACCATCCGGTACAACCAGTCCGCCGGCGGCGACATGGAGATCACCACGCACTCCTTCAACTGCGGTGGCGA
GTTCTTCTACTGCAACACGTCCAAGCTGTTCAACTCCACGTACAACGACACCTACATCTCCACGAACTCGACCAACTCGTCG
GCCAACAACTCGTCCATCATCACGCTCCAGTGCCGGATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCCCCGACAA
CAAGACGGAGACCTTCAGGCCAGCGGGAGGCGACATGCGGGACAACTGGCGCTCCGAGCTGTACAAGTACAAGGTGGTGGAG
GTCCAGCCCCTGGGCATCGCACCCACCGGGGCCAAGgagCGGGTCGTGGAGCGCGAGAAGgagGCGGTGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCT
CTCCGGCATCGTGCAGCAGCAGTCCAACCTCCTGAGGGCCATCGAGGCCCAGCAGCACATGCTGCAGCTGACCGTGTGGGGC
ATCAAGCAGCTGCAGGCCAGGGTGCTCGCGCTCGAGCGCTACCTGAAGGACCAGCAGCTGCTCGGCATCTGGGGCTGCTCCG
GCAAGCTGATCTGCACGACCAACGTGCCCTGGAACACGTCCTGGTCCAACAAGTCGGAGACCGACATCTGGGGCAACATGAC
CTGGATGCAGTGGGAGCGCGAGATCTCCAACTACACCGAGACCATCTACAAGCTCCTCGAGGACTCCCAGAACCAGCAGGAG
CGGAACGAGCAAGACCTGCTCGCGCTGGACTCGTGGAACTCGCTGTGGTCGTGGTTCAACATCACCAAGTGGCTGTGGTACA
TCAAgTAGTgAGaattcggttaccgggtcccggatcc
>HV1300884_CH848.3.d1621.4.44gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCACGACCGAGAAGATGTCCAACGTCACCGTCAACAACATCACCATCGAGGAGATGAAGAAC
TGCTCCTTCAACACCACGACGGAGATCCGCGACAAGATCAAGAAGGAGCGGGCCCTGTTCTACCGCCCCGACATCGTGCCGC
TGAACGACGAGACGAACAACACCTCCAAGTACAGGCTGATCAACTGCAACACCTCCGCGGTCACGCAGGCGTGCCCCAAGGT
CACGTTCGAGCCCATCCCCATCCACTACTGCGCCCCCGCCGGCTACGCCATCCTGAAGTGCAACGACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGGAGAAGGAGATCGTCATCCGGTCCGAGAACCTCACGAACAACGCGAAGATCATCATCGTGCACCTGCACGC
CCCGGTGGAGATCGTGTGCACCCGCCCGTACAACAACACGCGCAAGTCCGTGCGGATCGGCCCTGGCCAGACCTTCTACGCC
ACCGGCGACATCATCGGCGACCCGCGGCAGGCCCACTGCAACATCTCGAAGGAGATCTGGAACAAGACCCTGCAGGAGGTGG
GCAAGGAGCTGCAGAAGCACTTCCCCAACAAGACCATCCGGTACAACCAGTCCGCCGGCGGCGACATGGAGATCACCACGCA
CTCCTTCAACTGCGGTGGCGAGTTCTTCTACTGCAACACGTCCAACCTGTTCAACTCCACGTACAACGACACCTACATCTCC
CCCAACTCGACCAACTCGACGTCCATCATCACGCTCCAGTGCAAGATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CATCAACAACGTGTCCAACGAGACGGAGACCTTCAGGCCAGCGGGAGGCGACATGCGGGACAACTGGCGCTCCGAGCTGTAC
AAGTACAAGGTGGTGGAGGTCCAGCCCCTGGGCATCGCACCCACCGGGGCCAAGgagCGGGTCGTGGAGCGCGAGAAGgagG
CGGTGGGCCTCGGCGCCCTGTTCCTGGGCTTCCTGGGCGCTGCGGGCTCCACCATGGGTGCCGCGTCCATCACCCTGACCGT
GCAGGCCCGCCAGCTGCTCTCCGGCATCGTGCAGCAGCAGTCCAACCTCCTGAGGGCCATCGAGGCCCAGCAGCACATGCTG
CAGCTGACCGTGTGGGGCATCAAGCAGCTGCAGGCCAGGGTGCTCGCGCTCGAGCGCTACCTGAAGGACCAGCAGCTGCTCG
GCATCTGGGGCTGCTCCGGCAAGCTGATCTGCACGACCAACGTGCCCTGGAACACGTCCTGGTCCAACAAGTCGGAGACCGA
CATCTGGAACAACATGACCTGGATGCAGTGGGAGCGCGAGATCTCCAACTACACCGGGACCATCTACAAGCTCCTCGAGGAC
```

Figure 7 continued

```
TCCCAGAACCAGCAGGAGCGGAACGAGAAGGATCTGCTCGCGCTGGACTCGTGGAACTCGCTGTGGTCGTGGTTCAACATCA
CCAAGTGGCTGTGGTACATCAAgTAGTgAGaattcggttaccaggacccggatcc
>HV1300885_CH848.3.d1621.4.46gp140C
GgtcgacaagaaGCCACCATGCGCGTGATGGGCATCCTGAAGAACTACCCGCGGTGGTGGATCTGGGGCATCCTGGGCTTCT
GGATGCTCATGATCTGCAACggcAAGGGCAAGCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCTCGCCGCAGGAGCTGGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCATCGTCAAGAACTCCACGACCGAGGAGCTGTCCAACGCCCTCGCGCGGAACTCGACCACCGAGGAGATGAAGAAC
TGCTCCTTCAACACCACGACGGAGATCCGCGACAAGGAGAAGAAGGAGTACGCCCTGTTCTACCGCCCCGACATCGTGCCGC
TGAACAACAAGACGTCCAACATCTCCGAGTACAGGCTGATCAACTGCAACACCTCCACCGTCACGCAGGCGTGCCCCAAGGT
CACGTTCGAGCCCATCCCCATCCACTACTGCGCCCCCGCCGGCTACGCCATCCTGAAGTGCAACAACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGAAGGAGGGCATCGTCATCCGGTCCGAGAACCTCACGAACAACGCGAAGATCATCATCGTGCAGCTGAACGC
CAACGCCTCGGTGGAGATCGTGTGCACCCGCCCGAACAACAACACGCGCAAGTCCGTGCGGATCGGCCCTGGCCAGACCTTC
TACGCCACCGGCGACATCATCGGCAACATCCGGCAGGCCCACTGCAACATCTCGGAGAAGAAGTGGAACGAGACCCTGCAGA
AGGTGGGCATCGAGCTGCAGAAGCACTTCCCCAACAAGACCATCAAGTACAACCAGTCCGCCGGCGGCGACATGGAGATCAC
CACGCACTCCTTCAACTGCGGTGGCGAGTTCTTCTACTGCAACACGGCCAAGCTGTTCAACTCCACGTACAACGGCACCTAC
ATCTCCACGAACTCGATCAACTCGACGCTGAACATCACGCTCCAGTGCCGGATCAAGCAGATCATCAACATGTGGCAGGGGG
TGGGCCGCGCTATGTACGCACCGCCCATCGCCGGCAACATCACCTGCCGGTCCAACATCACCGGCCTCCTGCTGACCCGCGA
CGGCGGCATCCACAACGACTCCAACGAGACGGAGACCTTCAGGCCAGCGGGAGGCGACATGCGGGACAACTGGCGCTCCGAG
CTGTACAAGTACAAGGTGGTGGAGATCCAGCCCCTGGGCATCGCACCCACCGGGGCCAAGgagCGGGTCGTGGAGCGCGAGA
AGgagGCGGCCGGCCTCGGCGCCCTGTTCCTGGGCTTCCTGGGCGCTGCGGGCTCCACCATGGGTGCCGCGTCCATCACCCT
GACCGTGCAGGCCCGCCAGCTGCTCTCCGGCATCGTGCAGCAGCAGTCCAACCTCCTGAGGGCATCGAGGCCCAGCAGCAC
ATGCTGCAGCTGACCGTGTGGGGCATCAAGCAGCTGCAGGCCAGGGTGCTCGCGCTCGAGCGCTACCTGAAGGACCAGCAGC
TGCTCGGCATCTGGGGCTGCTCCGGCAAGCTGATCTGCACGACCAACGTGCCCTGGAACACGTCCTGGTCCAACAAGTCGGA
GACCGACATCTGGGACAACATGACCTGGATGCAGTGGGAGCGCGAGATCTCCAACTACACCGGGACCATCTACAAGCTCCTC
GAGGAGTCCCAGAACCAGCAGGAGCGGAACGAGCAAGACCTGCTCGCGCTGGACTCGTGGAACTCGCTGTGGAACTGGTTCA
ACATCACCAAGTGGCTGTGGTACATCAAgTAGTgAGaattcggttaccaggtcccggatcc
>HV1300886_CH848.3.d1635.10.35gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCACGACCGAGGAGATCAGCAACGCCACCGTCAAGAACATCACCATCAAGGAGATGAAGAAC
TGCTCCTTCAACACCACGACGGAGATCCGCGACAAGATCAAGAAGGAGCGGGCCCTGTTCTACCGCACCGACATCGTGCCGC
TGAACAAGGAGACGGGCAACATCTCCGAGTACAGGCTGATCAACTGCAACACCTCCGCGGTCACGCAGGCGTGCCCCAAGGT
CACGTTCGAGCCCATCCCCATCCACTACTGCGCCCCCGCCGGCTACGCCATCCTGAAGTGCAACGACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGGAAGGAGATCGTCATCCGGTCCGAGAACCTCACGAACAACGCGAAGATCATCATCGTGCACCTGCACAA
CCCGGTGGAGATCGTGTGCACCCGCCCGTACAACAACACGCGCAAGTCCGTGCGGATCGGCCCTGGCCAGACCTTCTACGCC
ACCGGCGACATCATCGGCGACCCGCGGCAGGCCCACTGCAACATCTCGAAGGAGGAGTGGAACAAGACCCTGCAGGAGGTGG
GCAAGGAGCTGCAGAAGCACTTCCCCAACAAGACCATCCGGTACAACCAGTCCGCCGGCGGCGACATGGAGATCACCACGCA
CTCCTTCAACTGCGGTGGCGAGTTCTTCTACTGCAACACGTCCAACCTGTTCAACTCCACGTACAACGACACCTACATCTCC
CCCAACTCGACCAACTCGACGTCCATCATCACGCTCCAGTGCCGGATCAAGCAGATCATCAACATGTGGCAGGGGGTGGGCC
GCGCTATGTACGCACCGCCCATCGCCGGCAACATCACCTGCAAGTCCAACATCACCGGCCTCCTGCTGACCCGCGACGGCGG
CATCAACAACGTGTCCAACGAGACGGAGACCTTCAGGCCAGCGGGAGGCGACATGCGGGACAACTGGCGCTCCGAGCTGTAC
AAGTACAAGGTGGTGGAGGTCCAGCCCCTGGGCATCGCACCCACCGGGGCCAAGgagCGGGTCGTGGAGCGCGGCAAGgagG
CGGCCGGCCTCGGCGCCCTGTTCCTGGGCTTCCTGGGCGCTGCGGGCTCCACCATGGGTGCCGCGTCCATCACCCTGACCGT
GCAGGCCCGCCAGCTGCTCTCCGGCATCGTGCAGCAGCAGTCCAACCTCCTGAGGGCCATCGAGGCCCAGCAGCACATGCTG
CAGCTGACCGTGTGGGGCATCAAGCAGCTGCAGGCCAGGGTGCTCGCGCTCGAGCGCTACCTGAAGGACCAGCAGCTGCTCG
GCATCTGGGGCTGCTCCGGCAAGCTGATCTGCACGACCAACGTGCCCTGGAACACGTCCTGGTCCAACAAGTCGGAGATGGA
CATCTGGAACAACATGACCTGGATGCAGTGGGAGCGCGAGATCTCCAACTACACCGGGACCATCTACAAGCTCCTCGAGGAC
```

Figure 7 continued

```
TCCCAGAACCAGCAGGAGCGGAACGAGCAAGACCTGCTCGCGCTGGACTCGTGGAACTCGCTGTGGAACTGGTTCGACATCA
CCAAGTGGCTGTGGTACATCAAgTAGTgAGaattcggttaccgggacctggatcc
>HV1300887_CH848.3.d1651.7.34gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCACGACCGAGAAGATGAGCAACGTCACCGTCAACAACATCACCATCGAGGAGATGAAGAAC
TGCTCCTTCAACACCACGACGGAGATCCGCGACAAGATCAAGAAGGAGCGGGCCCTGTTCTACCGCCCGGACATCGTGCCGC
TGAACGACGAGACGAACAACACCTCCAAGTACAGGCTGATCAACTGCAACACCTCCGCGGTCACGCAGGCGTGCCCCAAGGT
CACGTTCGAGCCCATCCCCATCCACTACTGCGCCCCCGCCGGCTACGCCATCCTGAAGTGCAACGACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGGAGAAGGAGATCGTCATCCGGTCCGAGAACCTCACGAACAACGTGAAGACCATCATCGTGCACCTGCACGC
CCCGGTGGAGATCGTGTGCACCCGCCCGTACAACAACACGCGCAAGTCCGTGCGGATCGGCCCTGGCCAGACCTTCTACGCC
ACCGGCGACATCATCGGCGACCCGCGGAAGGCCCACTGCAACATCTCGGAGAAGGACTGGAACAAGACCCTGCAGGAGGTGG
GCAAGGAGCTGCAGAAGCACTTCCCCAACAAGACCATCCGGTACAACCAGTCCGCCGGCGGCGACATGGAGATCACCACGCA
CTCCTTCAACTGCGGTGGCGAGTTCTTCTACTGCAACACGTCCAAGCTGTTCAACTCCACGTACAACGACACCTACATCTCC
ACCAACTCGACCAACTCGTCGGCCAACAACTCGTCCATCATCACGCTCCAGTGCCGGATCAAGCAGATCATCAACATGTGGC
AGGGGGTGGGCCGCGCTATGTACGCACCGCCCATCGCCGGCAACATCACCTGCAAGTCCAACATCACCGGCCTCCTGCTGAC
CCGCGACGGCGGCCCGGACAACAAGACGGAGACCTTCAGGCCAGCGGGAGGCGACATGCGGGACAACTGGCGCTCCGAGCTG
TACAAGTACAAGGTGGTGGAGGTCCAGCCCCTGGGCATCGCACCCACCGGGGCCAAGgagCGGGTCGTGGAGCGCGAGAAGg
agGCGGTCGGCCTCGGCGCCCTGTTCCTGGGCTTCCTGGGCGCTGCGGGCTCCACCATGGGTGCCGCGTCCATCACCCTGAC
CGTGCAGGCCCGCCAGCTGCTCTCCGGCATCGTGCAGCAGCAGTCCAACCTCCTGAGGGCCATCGAGGCCCAGCAGCACATG
CTGCAGCTGACCGTGTGGGGCATCAAGCAGCTGCAGGCCAGGGTGCTCGCGCTCGAGCGCTACCTGAAGGACCAGCAGCTGC
TCGGCATCTGGGGCTGCTCCGGCAAGCTGATCTGCACGACCAACGTGCCCTGGAACACGTCCTGGTCCAACAAGTCGGAGAC
CGACATCTGGGGCAACATGACCTGGATGCAGTGGGAGCGCGAGATCTCCAACTACACCGAGACCATCTACAAGCTCCTCGAG
GACTCCCAGAACCAGCAGGAGCGGAACGAGCAAGACCTGCTCGCGCTGGACTCGTGGAACTCGCTGTGGTCCTGGTTCAACA
TCACCAAGTGGCTGTGGTACATCAAgTAGTgAGaattcggttaccgggtcctggatcc
>HV1300888_CH848.3.d1651.7.50gp140C
GgtcgacaagaaGCCACCATGCGCGTGATGGGCATCCTGAAGAACTACCCGCGGTGGTGGATCTGGGGCATCCTGGGCTTCT
GGATGCTCATGATCTGCAACggcAAGGGCAAGCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCTCGCCGCAGGAGCTGGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCATCGTCAAGAACTCCACGACCGAGGAGCTGTCCAACGCCCTCGCGCGGAACTCGACCACCGAGGAGATGAAGAAC
TGCTCCTTCAACACCACGACGGAGATCCGCGACAAGGAGAAGAAGGAGTACGCCCTGTTCTACCGCCCCGACATCGTGCCGC
TGAACAACAAGACGTCCAACATCTCCGAGTACAGGCTGATCAACTGCAACACCTCCACCGTCACGCAGGCGTGCCCCAAGGT
CACGTTCGAGCCCATCCCCATCCACTACTGCGCCCCCGCCGGCTACGCCATCCTGAAGTGCAACAACGAGACCTTCAACGGG
ACCGGCCCGTGCAGCAACGTCTCCACCGTGCAGTGCACGCACGGCATCCGGCCCGTGGTGTCCACGCAGCTGCTCCTGAACG
GGTCGCTGGCGGAGAAGGGCATCGTCATCCGGTCCGAGAACCTCACGAACAACGCGAAGATCATCATCGTGCAGCTGAACGC
CAACGCCTCGGTGGAGATCGTGTGCACCCGCCCGAACAACAACACGCGCAAGTCCGTGCGGATCGGCCCTGGCCAGACCTTC
TACGCCACCGGCGACATCATCGGCAACATCCGGCAGGCCCACTGCAACATCTCGGAGAAGAAGTGGAACGAGACCCTGCAGA
AGGTGGGCATCGAGCTGCAGAAGCACTTCCCCAACAAGACCATCAAGTACAACCAGTCCGCCGGCGGCGACATGGAGATCAC
CACGCACTCCTTCAACTGCGGTGGCGAGTTCTTCTACTGCAACACGACCAAGCTGTTCAACTCCACGTACAACGGCACCTAC
ATCTCCACGAACTCGATCAACTCGACGCTGAACATCACGCTCCAGTGCCGGATCAAGCAGATCATCAACATGTGGCAGGGGA
TCGGCCGCGCTATGTACGCACCGCCCATCGCCGGCAACATCACCTGCCGGTCCAACATCACCGGCCTCCTGCTGACCCGCGA
CGGCGGCCATCCACAACGACTCCAACGAGACGGAGACCTTCAGGCCAGCGGGAGGCGACATGCGGGACAACTGGCGCTCCGAG
CTGTACAAGTACAAGGTGGTGGAGATCCAGCCCCTGGGCATCGCACCCACCGGGGCCAAGgagCGGGTCGTGGAGCGCGGGA
AGgagGCGGCCGGCCTCGGCGCCCTGTTCCTGGGCTTCCTGGGCGCTGCGGGCTCCACCATGGGTGCCGCGTCCATCACCCT
GACCGTGCAGGCCCGCCAGCTGCTCTCCGGCATCGTGCAGCAGCAGTCCAACCTCCTGAGGGCCATCGAGGCCCAGCAGCAC
ATGCTGCAGCTGACCGTGTGGGGCATCAAGCAGCTGCAGGCCAGGGTGCTCGCGCTCGAGCGCTACCTGAAGGACCAGCAGC
TGCTCGGCATCTGGGGCTGCTCCGGCAAGCTGATCTGCACGACCAACGTGCCCTGGAACACGTCCTGGTCCAACAAGTCGGA
GATGGACATCTGGGACAACATGACCTGGATGCAGTGGGAGCGCGAGATCTCCAACTACACCGGGACCATCTACAAGCTCCTC
```

Figure 7 continued

```
GAGGACTCCCAGAACCAGCAGGAGCGGAACGAGCAAGACCTGCTCGCGCTGGACTCGTGGAACTCGCTGTGGAACTGGTTCG
ACATCACCAAGTGGCTGTGGTACATCAAgTAGTgAGgtgaccgggacccgaattcggatcc
>HV1300889_CH848.3.d1651.10.04gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCAACGCCACGGTCGAGAACTCCACGGAGGCCATGAAGAACTGCTCCTTCAACACCACGACG
GAGATCCGCGACAAGATCAAGAAGGAGCGGGCCCTGTTCTACCGCCCCGACATCGTGCCGCTCAACAACGAGACGGGCAACA
TCTCCGAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACGACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCGGAGAAGGAGA
TCGTCATCCGGTCCGAGAACCTCACGAACAACGCGAAGATCATCATCGTGCACCTGCACAACCCGGTGGAGATCGTGTGCAC
CCGCCCGTACAACAACACGCGCAAGTCCGTGCGGATCGGCCCTGGCCAGACCTTCTACGCCACCGGCGACATCATCGGCGAC
CCGCGGAAGGCCCACTGCAACATCTCGAAGGAGGAGTGGAACAAGACCCTGCAGGAGGTGGGCAAGGAGCTGCAGAAGCACT
TCCCCAACAAGACCATCCGGTACAACCAGTCCGCCGGCGGCGACATGGAGATCACCACGCACTCCTTCAACTGCGGTGGCGA
GTTCTTCTACTGCAACACGTCCAACCTGTTCAACTCCACGTACAACGACACCTACATCTCCCCGAACTCGACCAACTCGACC
TCCATCATCACGCTCCAGTGCCGGATCAAGCAGATCATCAACATGTGGCAGGGGGTGGGCCGCGCTATGTACGCACCGCCCA
TCGCCGGCAACATCACCTGCAAGTCCAACATCACCGGCCTCCTGCTGACCCGCGACGGCGGCCCCGAGTCCAACGAGACGGA
GACCTTCAGGCCAGCGGGAGGCGACATGCGGGACAACTGGCGCTCCGAGCTGTACAAGTACAAGGTGGTGGAGGTCCAGCCC
CTGGGCATCGCACCCACCGGGGCCAAGgagCGGGTCGTGGAGCGCGAGAAGgagGCGGCCGGCCTCGGCGCCCTGTTCCTGG
GCTTCCTGGGCGCTGCGGGCTCCACCATGGGTGCCGCGTCCATCACCCTGACCGTGCAGGCCCGCCAGCTGCTCTCCGGCAT
CGTGCAGCAGCAGTCCAACCTCCTGAGGGCCATCGAGGCCCAGCAGCACATGCTGCAGCTGACCGTGTGGGGCATCAAGCAG
CTGCAGGCCAGGGTGCTCGCGCTCGAGCGCTACCTGAAGGACCAGCAGCTGCTCGGCATCTGGGGCTGCTCCGGCAAGCTGA
TCTGCACGACCAACGTGCCCTGGAACACGTCCTGGTCCAACAAGTCGGAGACCGACATCTGGGGCAACATGACCTGGATGCA
GTGGGAGCGCGAGATCTCCAACTACACCGAGACCATCTACAAGCTCCTCGAGGACTCCCAGAACCAGCAGGAGCGGAACGAG
CAAGACCTGCTCGCGCTGGACTCGTGGAACTCGCTGTGGTCGTGGTTCAACATCACCAAGTGGCTGTGGTACATCAAgTAGT
gAGgtcaccgggacccgaattcggatcc
>HV1300890_CH848.3.d1677.521.gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACAAGAAGGAGGTGCACAACGTGTGGGCGACCCACGCCTGCGTGCCCACG
GACCCCTCGCCGCAGGAGCTGTTCCTGAAGAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGATCTGCTC
GAACGCCATCGTCAAGAACTCCAACGCCACCGTCGGGAACTCCACGGAGGCCATGAAGAACTGCTCCTTCAACACCACGACG
GAGATCCGCGACAAGATCAAGAAGGAGCGGGCCCTGTTCTACCGCCCCGACATCGTGCCGCTGAACGACGAGACGAACAACA
CCTCCAAGTACAGGCTGATCAACTGCAACACCTCCGCGGTCACGCAGGCGTGCCCCAAGGTCACGTTCGAGCCCATCCCCAT
CCACTACTGCGCCCCCGCCGGCTACGCCATCCTGAAGTGCAACGACGAGACCTTCAACGGGACCGGCCCGTGCAGCAACGTG
TCCACCGTGCAGTGCACGCACGGCATCCGGCCCGTGGTGTCCACGCAGCTGCTCCTGAACGGGTCGCTGGCGGAGAAGGAGA
TCGTCATCCGGTCCGAGAACCTCACGAACAACGTGAAGATCATCATCGTGCACCTGCACACGCCGGTGCAGATCGTGTGCAC
CCGCCCGTACAACAACACGCGCAAGTCCGTGCGGATCGGCCCTGGCCAGACCTTCTACGCCACCGGCGACATCATCGGCGAC
CCGCGGAAGGCCCACTGCAACATCTCGGAGAAGGACTGGAACAAGACCCTGCAGGAGGTGGGCAAGGAGCTGCAGAAGCACT
TCCCCAACAAGACCATCCGGTACAACCAGTCCGCCGGCGGCGACATGGAGATCACCACGCACTCCTTCAACTGCGGTGGCGA
GTTCTTCTACTGCAACACGTCCAAGCTGTTCAACTCCACGTACAACGACACCTACATCTCCACGAACTCGACCAACTCGTCG
GCCAACAACTCGTCCATCATCACGCTCCAGTGCCGGATCAAGCAGATCATCAACATGTGGCAGGGGGTGGGCCGCGCTATGT
ACGCACCGCCCATCGCCGGCAACATCACCTGCAAGTCCAACATCACCGGCCTCCTGCTGACCCGCGACGGCGGCCCCGACAA
CAAGACGGAGACCTTCAGGCCAGCGGGAGGCGACATGCGGGACAACTGGCGCTCCGAGCTGTACAAGTACAAGGTGGTGGAG
GTCCAGCCCCTGGGCATCGCACCCACCGGGGCCAAGgagCGGGTCGTGGAGCGCGAGAAGgagGCGGTGGGCCTCGGCGCCC
TGTTCCTGGGCTTCCTGGGCGCTGCGGGCTCCACCATGGGTGCCGCGTCCATCACCCTGACCGTGCAGGCCCGCCAGCTGCT
CTCCGGCATCGTGCAGCAGCAGTCCAACCTCCTGAGGGCCATCGAGGCCCAGCAGCACATGCTGCAGCTGACCGTGTGGGGC
ATCAAGCAGCTGCAGGCCAGGGTGCTCGCGCTCGAGCGCTACCTGAAGGACCAGCAGCTGCTCGGCATCTGGGGCTGCTCCG
GCAAGCTGATCTGCACGACCAACGTGCCCTGGAACACGTCCTGGTCCAACAAGTCGGAGACCGACATCTGGGGCAACATGAC
CTGGATGCAGTGGGAGCGCGAGATCTCCAACTACACCGAGACCATCTACAAGCTCCTCGAGGACTCCCAGAACCAGCAGGAG
```

Figure 7 continued

```
CGGAACGAGCAAGACCTGCTCGCGCTGGACTCGTGGAACTCGCTGTGGTCGTGGTTCAACATCACCAAGTGGCTGTGGTACA
TCAAgTAGTgAGgtaaccgggacccgaattcggatcc
>HV1300891_CH848.3.d1720.5gp140C
GgtcgacaagaaGCCACCATGCGCGTGACGGGCATCCTGAAGAACTGCCCGCTCTGGTGGATCTGGGGCATCCTGGGCTTCT
GGATGCTCATGAACTGCAACggcGAGGGCAACCTCTGGGTGACGGTCTACTACGGCgtgCCGGTGTGGAAGGAGGCCAAGAC
GACCCTGTTCTGCGCGTCGGACGCCAAGGCCTACGTGAAGGAGGTGCACAACGTGTGGGCGACCCACGCCTGCGTGCCCACG
GACCCCTCGCCGCAGGAGCTGGTCCTGGACAACGTGACCGAGAACTTCAACATGTGGAAGAACGACATGGTGGACCAGATGC
ACGAGGACATCATCTCCCTGTGGGACCAGTCCCTGAAGCCCTGCGTGAAGCTGACCCCGCTGTGCGTGACCCTGAACTGCTC
GAACGCCATCGTCCGGAACTCCACGACCGAGAAGATGTCCGACGCGCTGGACCGCAACTCGACGACCGAGGAGATGAAGAAC
TGCTCCTTCAACACCACGACGGAGATCCGCGACAAGGAGAAGAAGGAGTACGCCCTGTTCTACCGCCCCGACATCGTGCCGC
TGAACAACAAGACGTCCAACATCTCCGAGTACAGGCTGATCAACTGCAACACCTCCACCGTCACGCAGGCGTGCCCCAAGGT
CACGTTCGAGCCCATCCCCATCCACTACTGCGCCCCCGCCGGCTACGCCATCCTGAAGTGCAACAACGAGACCTTCAACGGG
ACCGGCCCGTGCAGCAACGTGTCCACCGTGCAGTGCACGCACGGCATCCGGCCCGTGGTGTCCACGCAGCTGCTCCTGAACG
GGTCGCTGGCGAAGGAGGAGATCGTCATCCGGTCCGAGAACCTCACGAACAACGCCAAGATCATCATCGTGCAGCTGAACGC
GAACGCCTCCGTGGAGATCGTGTGCACCCGCCCGAACAACAACACGCGCAAGTCCGTGCGGATCGGCCCTGGCCAGACCTTC
TACGCCACCGGCGACATCATCGGCGACATCCGGCAGGCCCACTGCAACATCTCGGAGAAGAAGTGGAACGAGACCCTGCAGC
AGGTGGGCATCGAGCTGCAGAAGCACTTCCCCAACAAGACCATCAAGTACAACCAGTCCGCCGGCGGCGACATGGAGATCAC
CACGCACTCCTTCAACTGCGGTGGCGAGTTCTTCTACTGCAACACGGCCAAGCTGTTCAACTCCACGTACAACGGCACCTAC
ATCTCCACGGACTCGATCAACTCGACCCTCAACATCACGCTCCAGTGCCGGATCAAGCAGATCATCAACATGTGGCAGGGGG
TGGGCCGCGCTATGTACGCACCGCCCATCGCCGGCAACATCACCTGCCGGTCCAACATCACCGGCCTCCTGCTGACCCGCGA
CGGCGGCATCCACAACGACTCGAACGTGACGGAGACCTTCAGGCCAGCGAGGGAGGCGACATGCGGGACAACTGGCGCTCCGAG
CTGTACAAGTACAAGGTGGTGGAGATCCAGCCCCTGGGCATCGCACCCACCGGGGCCAAGgagCGGGTCGTGGGGCGCGAGA
AGgagGCGGCCGGCCTCGGCGCCCTGTTCCTGGGCTTCCTGGGCGCTGCGGGCTCCACCATGGGTGCCGCGTCCATCACCCT
GACCGTGCAGGCCCGCCAGCTGCTCTCCGGCATCGTGCAGCAGCAGTCCAACCTCCTGAGGGCCATCGAGGCCCAGCAGCAC
ATGCTGCAGCTGACCGTGTGGGGCATCAAGCAGCTGCAGGCCAGGGTGCTCGCGCTCGAGCGCTACCTGAAGGACCAGCAGC
TGCTCGGCATCTGGGGCTGCTCCGGCAAGCTGATCTGCACGACCAACGTGCCCTGGAACACGTCCTGGTCCAACAAGTCGGA
GACCGACATCTGGGACAACATGACCTGGATGCAGTGGGAGCGCGAGATCTCCAACTACACCGGGACCATCTACAAGCTCCTC
GAGGAGTCCCAGAACCAGCAGGAGCGGAACGAGCAAGACCTGCTCGCGCTGGACTCGTGGAACTCGCTGTGGTCGTGGTTCA
ACATCACCAAGTGGCTGTGGTACATCAAgTAGTgAGgttaccgggacccgaattcggatcc*
>HV1301062, CH0848.3.D0526.25.26

GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAACCTCTGGGTGACGGTGTACTACGGCgtgCCGGTGTGGAAGGAGGCCAAG
ACGACCCTGTTCTGCGCGTCGGACGCCCGCGCCTACGAGAAGGAGGTGCACAACGTGTGGGCGACCCACGCCTGCGTG
CCCACGGACCCCAGCCCGCAGGAGCTCTTCCTGGAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGAACTGCTCGAACGTCAACGTGACGCGGTCGAACGTGAACGTCACGAACATCACGAACACGATCAAGGGCGAG
ATGAAGAACTGCTCCTTCAACACGACGACGGAGATCCGCGACAAGGAGAAGAAGGAGTACGCCCTGTTCTACCGCTCG
GACGTGGTGCCGCTGAACGAGACCAGCAACACCTCGGAGTACAGGCTGATCAACTGCAACACCTCCGCGGTCACGCAG
GCGTGCCCCAAGGTCACGTTCGAGCCCATCCCCATCCACTACTGCGCCCCCGCCGGCTACGCCATCCTGAAGTGCAAC
AACGAGACCTTCAACGGGACCGGCCCGTGCAGCAACGTGTCCACCGTGCAGTGCACGCACGGCATCCGGCCCGTGGTG
TCCACGCAGCTGCTCCTGAACGGGTCGCTGGCGGAAGGAGATCGTCATCCGGTCCGAGAACCTCACGAACAACGCGG
AAGATCATCATCGTGCACCTGCACACGCCCGTGGAGATCGTGTGCACCCGCCCGGGCAACAACACGCGCAAGTCCGTC
CGGATCGGCCCTGGCCAGACCTTCTACGCCACCGGCGACATCATCGGCGACATCCGCCAGGCCCACTGCAACATCAGC
GAGGAGAAGTGGAACAAGACCCTGCACGAGGTGTCGAAGGAGCTGCAGAAGCACTTCCCCAACAAGACGATTAAGTAC
GCGCAGTCGGCCGGCGGCGACATGGAGATCACCACGCACTCCTTCAACTGCGGTGGCGAGTTCTTCTACTGCAACACG
TCGAACCCTGTTCAACGGCACCTACAACGGCACCTACATCTCGACGAACTCGTCCGCGAACTCCAACAGCACGATCACG
CTCCAGTGCCGCATCAAGCAGATCATCAACATGTGGCAGGGGGTGGGCCGCGCTATGTACGCACCGCCCATCGCCGGC
AACATCACCTGCCGCTCCAACATCACCGGCCTCCTGCTGACCCGCGACGGCGGCATCAACAACAACAAGACGGAGGAG
ACCTTCAGGCCAGCGGGAGGCGACATGCGCGAACTGGCGCTCCGAGCTGTACAAGTACAAGGTGGTGGAGATCCAG
CCCCTGGGCATCGCACCCACCGGGGCCAAGgagCGGGTCGTGGAGCGCGAGAAGgagGCGGCGGGCCTCGGCGCCCTG
TTCCTGGGCTTCCTGGGCGCTGCGGGCTCCACCATGGGTGCCGCGTCCATCACCCTGACCGTGCAGGCCCGCCAGCTG
CTCTCCGGCATCGTGCAGCAGCAGTCCAACCTCCTGAGGGCCATCGAGGCCCAGCAGCACATGCTGCAGCTGACCGTG
TGGGGCATCAAGCAGCTGCAGGCCAGGGTGCTCGCGCTCGAGCGCTACCTGAAGGACCAGCAGCTGCTCGGCATGTGG
GGCTGCTCCGGCAAGCTGATCTGCACGACCAACGTGCCCTGGAACACGTCCTGGTCCAACAAGTCGGAGAAGGACATC
TGGGACAACATGACCTGGATGCAGTGGGAGCGCGAGATCTCCAACTACACCGAGACCATCTACATGCTCCTCGAGGAC
```

Figure 7 continued

TCCCAGCGCCAGCAGGAGCGGAACGAGAAGGATCTGCTCGCGCTGGACTCGTGGAACTCCCTGTGGAACTGGTTCAAC
ATCACCAACTGGCTGTGGtacatcaagTAGTAAgggatcc

>HV1301063, CH0848.3.D0700.15.34

GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGGAAGCTCTGGGTGACGGTGTACTACGGCgtgCCGGTGTGGAAGGAGGCCAAG
ACGACCCTGTTCTGCGCGTCGGACGCCCGCCTACGAGAAGGAGGTGCACAACGTGTGGGCGACCCACGCCTGCGTG
CCCACGGACCCCAGCCCGCAGGAGCTCGTCCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAACAACCGCACCATGGGGGAGATGAAGAACTGCTCCTTCAACACGACGACG
GAGATCCGCGACAAGGAGAAGAAGGAGTACGCCCTGTTCTACAAGCCCGACGTCGTGCCGCTGGACGAGACCAACAAC
ACCTCGGAGTACAGGCTGATCAACTGCAACACCTCCGCGGTCACGCAGGCGTGCCCCAAGGTCACGTTCGAGCCCATC
CCCATCCACTACTGCGCCCCCGCCGGCTACGCCATCCTGAAGTGCAACAACGAGACCTTCAACGGCACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGAACACGCCC
GTGGAGATCGTGTGCACCCGCCCGAACAACAACACGCGCAAGTCCGTCCGGATCGGCCCTGGCCAGACCTTCTACGCC
ACCGGCGGCATCATCGGCGACATCCGCCAGGCCCACTGCAACATCAGCGAGGGGCAGTGGAACGAGACCCTGCAGAAG
GTGGGCAAGGAGCTGCAGAAGCACTTCCCCAACAAGACGATTAAGTACGAGCAGTCGGCCGGCGGCGACATGGAGATC
ACCACGCACTCCTTCAACTGCGGTGGCGAGTTCTTCTACTGCAACACGTCGAAGCTGTTCAACGGCACGTACAACGGC
ACCTACATCTCCACGAACTCGTCCACCAACTCGACGAGCACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCAACATCACCGGC
CTCCTGCTGACCCGCGACGGCGGCACGAACAGCTCGGAGGAGATCTTCAGGCCAGCGGGAGGCGACATGCGCGACAAC
TGGCGCTCCGAGCTGTACAAGTACAAGGTGGTGGAGATCCAGCCCCTGGGCATCGCACCCACCGGGGCCAAGgagCGG
GTCGTGGAGCGCGAGAAGgagGCGGCGGGCCTCGGCGCCCTGTTCCTGGGCTTCCTGGGCGCTGCGGGCTCCACCATG
GGTGCCGCGTCCATCACCCTGACCGTGCAGGCCCGCCAGCTGCTCTCCGGCATCGTGCAGCAGCAGTCCAACCTCCTG
AGGGCCATCGAGGCCCAGCAGCACATGCTGCAGCTGACCGTGTGGGGCATCAAGCAGCTGCAGGCCAGGGTGCTCGCG
CTCGAGCGCTACCTGAAGGACCAGCAGCTGCTCGGCATGTGGGGCTGCTCCGGCAAGCTGATCTGCACGACCAACGTG
CCCTGGAACACGTCCTGGTCCAACAAGTCGGAGAAGGACATCTGGGACAACATGACCTGGATGCAGTGGGAGCGCGAG
ATCTCCAACTACACCGAGACCATCTACAAGCTCCTCGAGGACTCCCAGAACCAGCAGGAGCGGAACGAGCAGGATCTG
CTCGCGCTGGACTCGTGGAACTCCCTGTGGAACTGGTTCAACATCACCAAGTGGCTGTGGtacatcaagTAGTAAggg
atcc

>HV1301064, CH0848.3.D0780.25.05

GgtcgacaagaaATGCGGGTGATGGGCATCCTCAAGAACTACCCGCAGTGGTGGATCTGGGGCATCCTGGGCTTCTGG
ATGCTCATGAACTGCAACggcAAGGAGAACCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAACAACCGCACCGACTACGACACGCGGTCCAACGTGAACGTGACCAACATC
ACGAACACGATCAAGGGGGAGATGAAGAACTGCTCCTTCAACACGACGACGGAGATCCGCGACAAGGAGAAGAAGGAG
TACGCCCTGTTCTACCGCCCCGACATCGTGCCGCTGAACGAGAACGAGACCAGCAACACCTCGGAGTACAGGCTGATC
AACTGCAACACCTCCGCGGTCACGCAGGCGTGCCCCAAGGTCACGTTCGAGCCCATCCCCATCCACTACTGCGCCCCC
GCCGGCTACGCCATCCTGAAGTGCAACGACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGAGATCGTCATC
CGGTCCGAGAACCTCACGAACAACGCGAAGATCATCATCGTGCACCTGAACACGTCGGTGGAGATCGTGTGCACCCGC
CCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGTCGAAGTGGAACGAGACCCTGCAGAAGGTGGGCATCGAGCTGCAGAAG
CACTTCCCCAACAAGACGATTAAGTACGAGCAGTCGGCCGGCGGCGACATGGAGATCACCACGCACTCCTTCAACTGC
GGTGGCGAGTTCTTCTACTGCAACACGTCGAACCTGTTCAACGGCACGTACAACGGCACCTACATCTCCACGAACTCG
TCCGCCAACTCGACGAGCACGATCACGCTCCAGTGCCGCATCAAGCAGATCATCAACATGTGGCAGGGGGTGGGCCGC
GCTATGTACGCACCGCCCATCGCCGGCAACATCACCTGCAAGTCCAACATCACCGGCCTCCTGCTGACCCGCGACGGC

Figure 7 continued

```
GGCACGAACAGCTCCGAGGAGATCTTCAGGCCAGCGGGAGGCGACATGCGCGACAACTGGCGCTCCGAGCTGTACAAG
TACAAGGTGGTGGAGATCCAGCCCCTGGGCATCGCACCCACCGGGGCCAAGgagCGGGTCGTGGAGCGCGAGAAGgag
GCGGCGGGCCTCGGCGCCCTGTTCCTGGGCTTCCTGGGCGCTGCGGGCTCCACCATGGGTGCCGCGTCCATCACCCTG
ACCGTGCAGGCCCGCCAGCTGCTCTCCGGCATCGTGCAGCAGCAGTCCAACCTCCTGAGGGCCATCGAGGCCCAGCAG
CACATGCTGCAGCTGACCGTGTGGGGCATCAAGCAGCTGCAGGCCAGGGTGCTCGCGCTCGAGCGCTACCTGAAGGAC
CAGCAGCTGCTCGGCATCTGGGGCTGCTCCGGCAAGCTGATCTGCACGACCAACGTGCCCTGGAACACCTCCTGGTCC
AACAAGTCGGAGAAGGACATCTGGGACAACATGACCTGGATGCAGTGGGAGCGCGAGATCTCCAACTACACCGAGACC
ATCTACAAGCTCCTCGAGGACTCCCAGAACCAGCAGGAGCGGAACGAGCAGGATCTGCTCGCGCTGGACTCGTGGAAC
TCCCTGTGGAACTGGTTCAACATCACCAAGTGGCTGTGGtacatcaagTAGTAAgggatcc
```

>HV1301065, CH0848.3.D0700.15.05

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGGAAGCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCGTGCTGGGGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAACAACCGCACCGTCTACGACTCGCGGTCCAACGACAACGTGACCTCGATC
AACAACACGATCATGGGGGAGATGAAGAACTGCTCCTTCAACGACGACGGAGATCCGCGACAAGGAGAAGAAGGAG
TACGCCCTGTTCTACCGCCCCGACATCGTGCCGCTGAACGAGAACGAGACCAGCAACACCTCGGAGTACAGGCTGATC
AACTGCAACACCTCCGCGGTCACGCAGGCGTGCCCCAAGGTCACGTTCGAGCCCATCCCCATCCACTACTGCGCCCCC
GCCGGCTACGCCATCCTGAAGTGCAACAACGAGACCTTCAACGGGACCGGCCCGTGCAGCAACGTGTCCACCGTGCAG
TGCACGCACGGCATCCGGCCCGTGGTGTCCACGCAGCTGCTCCTGAACGGGTCGCTGGCGGAGAAGGAGATCGTCATC
CGGTCCGAGAACCTCACGAACAACGCGAAGATCATCATCGTGCACCTGCACACGCCCGTGGAGATCGTGTGCACCCGC
CCGGGCAACAACACGCGCAAGTCCGTCCGGATCGGCCCTGGCCAGACCTTCTACGCCACCGGCGACATCATCGGCGAC
ATCCGCCAGGCCCACTGCAACATCAGCGAGGAGAAGTGGAACGAGACCCTGCAGAAGGTGGGCATCGAGCTGCAGAAG
CACTTCCCCAACAAGACGATTAAGTACGAGCAGTCGGCCGGCGGCGACATGGAGATCACCACGCACTCCTTCAACTGC
GGTGGCGAGTTCTTCTACTGCAACACGTCGAACCTGTTCAACGGCACGTACAACGGCACCTACATCTCCACGAACTCG
TCCGCCAACTCGACGAGCACGATCACGCTCCAGTGCCGCATCAAGCAGATCATCAACATGTGGCAGGGGGTGGGCCGC
GCTATGTACGCACCGCCCATCGCCGGCAACATCACCTGCAAGTCCAACATCACCGGCCTCCTGCTGACCCGCGACGGC
GGCACGAACAACACCAGCAACGAGGAGACGTTCAGGCCAGCGGGAGGCGACATGCGCGACAACTGGCGCTCCGAGCTG
TACAAGTACAAGGTGGTGGAGATCCAGCCCCTGGGCATCGCACCCACCGGGGCCAAGgagCGGGTCGTGGAGCGCGAG
AAGgagGCGGCGGGCCTCGGCGCCCTGTTCCTGGGCTTCCTGGGCGCTGCGGGCTCCACCATGGGTGCCGCGTCCATC
ACCCTGACCGTGCAGGCCCGCCAGCTGCTCTCCGGCATCGTGCAGCAGCAGTCCAACCTCCTGAGGGCCATCGAGGCC
CAGCAGCACATGCTGCAGCTGACCGTGTGGGGCATCAAGCAGCTGCAGGCCAGGGTGCTCGCGCTCGAGCGCTACCTG
AAGGACCAGCAGCTGCTCGGCATGTGGGGCTGCTCCGGCAAGCTGATCTGCACGACCGCCGTGGCGTGGAACACCTCC
TGGTCCAACAAGTCGGAGAAGGACATCTGGGACAACATGACCTGGATGCAGTGGGAGCGCGAGATCTCCAACTACACC
GAGACCATCTACAAGCTCCTCGAGGACTCCCAGAACCAGCAGGAGCGGAACGAGCAGGATCTGCTCGCGCTGGACTCG
TGGAACTCCCTGTGGAACTGGTTCAACATCACCAAGTGGCTGTGGtacatcaagTAGTAAgggatcc
```

>HV1301066, CH0848.3.D0794.3.03

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcGAGGGCAACCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGGACAACCGCACCGTCGGGGAGATGAAGAACTGCTCCTTCAACACGACGACG
GAGATCCGCGACAAGGAGAAGAAGGAGTACGCCCTGTTCTACCGCCCGGACATCGTGCCGCTGAACAACGAGACGTCG
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACAACGAGACCTTCAACGGGACCGGCCCG
TGCAGCAACGTGTCCACCGTGCAGTGCACGCACGGCATCCGGCCCGTGGTGTCCACGCAGCTGCTCCTGAACGGGTCG
CTGGCGGAGAAGGGGATCGTCATCCGGTCCGAGAACCTCACGAACAACGCGAAGATCATCATCGTGCAGCTGAACACG
```

Figure 7 continued

```
TCGGTGGAGATCGTGTGCACCCGCCCGAACAACAACACGCGCAAGTCCGTCCGGATCGGCCCTGGCCAGACCTTCTAC
GCCACCGGCGACATCATCGGCGAGATCCGGCAGGCCCACTGCAACATCAGCGAGGAGAAGTGGAACGAGACCCTGCAG
AAGGTGGGCAAGGAGCTGCAGAAGCACTTCCCCAACAAGACCATTAAGTACGCGCAGTCGGCCGGCGGCGACATGGAG
ATCACCACGCACTCCTTCAACTGCGGTGGCGAGTTCTTCTACTGCAACACGGCGAAGCTGTTCAACGGCACGTACAAC
GGCACCGACATCTCGACGAACTCGTCCACCAACTCGAACCCCACGATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACC
GGCCTCCTGCTGACCCGCGACGGCGGCACGAACTCGAGCGGCAAGGAGGAGATCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACG
ACCAACGTGCCCTGGAACACGTCCTGGTCCAACAAGTCGGAGACGGACATCTGGGACAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGAACTGGTTCAACATCACCAAGTGGCTGTGGtacatcaag
TAGTAAgggatcc
```

>HV1301067, CH0848.3.D0836.10.31

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcGAGGGCAACCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACTCCACCGTCGAGGAGATGAAGAACTGCTCCTTCAACACGACGACG
GAGATCCGCGACAAGGAGAAGAAGGAGTACGCCCTGTTCTACCGCCCGGACATCGTGCCGCTGAACAACGAGACGTCG
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCAACGTGTCCACCGTGCAGTGCACGCACGGCATCCGGCCCGTGGTGTCCACGCAGCTGCTCCTGAACGGGTCG
CTGGCGGAGAAGGGGATCGTCATCCGGTCCGAGAACCTCACGAACAACGCGAAGATCATCATCGTGCACCTGCACACG
CCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGGCAGGCCCACTGCAACATCAGCGAGTCCAAGTGGAACGAGACCCTGCAG
AAGGTGGGCAAGGAGCTGCAGAAGCACTTCCCCAACAAGACCATTAAGTACGCGCAGTCGGCCGGCGGCGACATGGAG
ATCACCACGCACTCCTTCAACTGCGGTGGCGAGTTCTTCTACTGCAACACGGCGAAGCTGTTCAACGGCACGTACAAC
GGCACGGACATCTCCACGAACTCCTCGACGAACTCGAACCCGACGATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACC
GGCCTCCTGCTGACCCGCGACGGCGGCACGAACTCGAGCGGGAAGGAGGAGATCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACG
ACCAACGTGCCCTGGAACACGTCCTGGTCCAACAAGTCGGAGACCGACATCTGGGACAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGAACTGGTTCAACATCACCAAGTGGCTGTGGtacatcaag
TAGTAAgggatcc
```

>HV1301068, CH0848.3.D0808.15.27

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
```

Figure 7 continued

```
ACGACCCTGTTCTGCGCGTCGGACGCCCGCGCCTACGAGAAGGAGGTGCACAACGTGTGGGCGACCCACGCCTGCGTG
CCCACGGACCCCAGCCCGCAGGAGCTCTTCCTGGACAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCTACGAGATGAAGAACTGCTCCTTCAACACGACGACG
GAGATCCGCGACAAGGAGAAGAAGGAGTACGCCCTGTTCTACCGCCCGGACATCGTGCCGCTGAACGAGAACGAGACG
TCGAACACCTCGGAGTACAGGCTGATCAACTGCAACACCTCCGCGGTCACGCAGGCGTGCCCCAAGGTCACGTTCGAG
CCCATCCCCATCCACTACTGCGCCCCGCCGGCTACGCCATCCTGAAGTGCAACAACGAGACCTTCAACGGGACCGGC
CCGTGCAGCAACGTGTCCACCGTGCAGTGCACGCACGGCATCCGGCCCGTGGTGTCCACGCAGCTGCTCCTGAACGGG
TCGCTGGCGGAGAAGGAGATCGTCATCCGGTCCGAGAACCTCACGAACAACGCGAAGATCATCATCGTGCACCTGAAC
ACGCCCGTGGAGATCGTGTGCACCCGCCCGAACAACAACACGCGCAAGTCCGTCCGGATCGGCCCTGGCCAGACCTTC
TACGCCACCGGCGACATCATCGGCGACATCCGGCAGGCCCACTGCAACATCAGCGAGAAGGAGTGGAACGAGACCCTG
CAGAAGGTGGGCAAGGAGCTGCAGAAGCACTTCCCCAACAAGACCATTAAGTACGAGCAGTCGGCCGGCGGCGACATG
GAGATCACCACGCACTCCTTCAACTGCGGTGGCGAGTTCTTCTACTGCAACACGTCGAACCTGTTCAACGGCACGTAC
AACGGCACCGACATCTCGACGAACTCGTCCGCGAAGTCGAACTCGACGATCACGCTCCAGTGCCGCATCAAGCAGATC
ATCAACATGTGGCAGGGGGTGGGCCGCGCTATGTACGCACCGCCCATCGCCGGCAACATCACCTGCAAGTCCAACATC
ACCGGCCTCCTGCTGACCCGCGACGGCGGCAACTCGTCGAAGACGGAGGAGGAGACGTTCAGGCCAGCGGGAGGCGAC
ATGCGCGACAACTGGCGCTCCGAGCTGTACAAGTACAAGGTGGTGGAGATCCAGCCCCTGGGCATCGCACCCACCGGG
GCCAAGgagCGGGTCGTGGAGCGCGAGAAGgagGCGGCGGGCCTCGGCGCCCTGTTCCTGGGCTTCCTGGGCGCTGCG
GGCTCCACCATGGGTGCCGCGTCCATCACCCTGACCGTGCAGGCCCGCCAGCTGCTCTCCGGCATCGTGCAGCAGCAG
TCCAACCTCCTGAGGGCCATCGAGGCCCAGCAGCACATGCTGCAGCTGACCGTGTGGGGCATCAAGCAGCTGCAGGCC
AGGGTGCTCGCGCTCGAGCGCTACCTGAAGGACCAGCAGCTGCTCGGCATGTGGGGCTGCTCCGGCAAGCTGATCTGC
ACGACCAACGTGCCCTGGAACACGTCCTGGTCCAACAAGTCGGAGATGGACATCTGGGACAACATGACCTGGATGCAG
TGGGAGCGCGAGATCTCCAACTACACCGAGACCATCTACATGCTCCTCGAGGACTCCCAGCGCCAGCAGGAGCGGAAC
GAGAAGGATCTGCTCGCGCTGGACTCGTGGAACTCCCTGTGGAACTGGTTCAACATCACCAAGTGGCTGTGGtacatc
aagTAGTAAgggatcc

>HV1301069, CH0848.3.D0949.10.18

GgtcgacaagaaATGCGCGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTCTACTACGGCgtgCCGGTGTGGAAGGAGGCCAAG
ACGACCCTGTTCTGCGCGTCGGACGCCCGCGCCTACGAGAAGGAGGTGCACAACGTGTGGGCGACCCACGCCTGCGTG
CCCACGGACCCCAGCCCGCAGGAGCTCTTCCTGGACAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGACGGCCACGGTGGACAACTCGACGGTGGAGGAGATGAAGAACTGCTCCTTCAACACGACGACG
GAGATCCGCGACAAGGAGAAGAAGGAGTACGCCCTGTTCTACCGCCCGGACATCGTGCCGCTGAACGAGAACGAGACG
TCGAACACCTCGGAGTACAGGCTGATCAACTGCAACACCTCCGCGGTCACGCAGGCGTGCCCCAAGGTCACGTTCGAG
CCCATCCCCATCCACTACTGCGCCCCGCCGGCTACGCCATCCTGAAGTGCAACAACGAGACCTTCAACGGGACCGGC
CCGTGCAGCAACGTGTCCACCGTGCAGTGCACGCACGGCATCCGGCCCGTGGTGTCCACGCAGCTGCTCCTGAACGGG
TCGCTGGCGGAGAAGGAGATCGTCATCCGGTCCGAGAACCTCACGAACAACGCGAAGATCATCATCGTGCACCTGCAC
ACGCCCGTGGAGATCGTGTGCACCCGCCCGAACAACAACACGCGCAAGTCCGTCCGGATCGGCCCTGGCCAGACCTTC
TACGCCACCGGCGACATCATCGGCGAGATCCGCCAGGCCCACTGCAACATCAGCGAGGAGGAGTGGAACGAGACCCTG
CAGAAGGTGGGCAAGGAGCTGCAGAAGCACTTCCCCAACAAGACCATTAAGTACGAGCAGTCGGCCGGCGGCGACATG
GAGATCACCACGCACTCCTTCAACTGCGGTGGCGAGTTCTTCTACTGCAACACGGCCAACCTGTTCAACGGGACGTAC
AACGGCACCGACATCTCCACGAACTCCTCGACGAAGTCGAACTCGACGATCACGCTCCAGTGCCGCATCAAGCAGATC
ATCAACATGTGGCAGGGGGTGGGCCGCGCTATGTACGCACCGCCCATCGCCGGCAACATCACCTGCAAGTCCAACGTG
ACCGGCCTCCTGCTGACCCGCGACGGCGGCACCAACTCGTCGCAGACCGAGGAGGAGACCTTCAGGCCAGCGGGAGGC
GACATGCGCGACAACTGGCGCTCCGAGCTGTACAAGTACAAGGTGGTGGAGATCCAGCCCCTGGGCATCGCACCCACC
GGGGCCAAGgagCGGGTCGTGGAGCGCGAGAAGgagGCGGCGGGCCTCGGCGCCCTGTTCCTGGGCTTCCTGGGCGCT
GCGGGCTCCACCATGGGTGCCGCGTCCATCACCCTGACCGTGCAGGCCCGCCAGCTGCTCTCCGGCATCGTGCAGCAG
CAGTCCAACCTCCTGAGGGCCATCGAGGCCCAGCAGCACATGCTGCAGCTGACCGTGTGGGGCATCAAGCAGCTGCAG
GCCAGGGTGCTCGCGCTCGAGCGCTACCTGAAGGACCAGCAGCTGCTCGGCATGTGGGGCTGCTCCGGCAAGCTGATC
TGCACGACCAACGTGCCCTGGAACACGTCCTGGTCCAACAAGTCGGAGATGGACATCTGGGACAACATGACCTGGATG
CAGTGGGAGCGCGAGATCTCCAACTACACCGAGACCATCTACAAGCTCCTCGAGGACTCCCAGAACCAGCAGGAGCGG
```

Figure 7 continued

```
AACGAGCAGGATCTGCTCGCGCTGGACTCGTGGAACTCCCTGTGGAACTGGTTCAACATCACCAAGTGGCTGTGGtac
atcaagTAGTAAgggatcc

>HV1301070, CH0848.3.D0808.15.25

GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCAAGGCCTACGAGAAGGAGGTGCACAACGTGTGGGCGACCCACGCCTGCGTG
CCCACGGACCCCAGCCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCGAGGAGATGAAGAACTGCTCCTTCAACACGACGACG
GAGATCCGCGACAAGGAGAAGAAGGAGTACGCCCTGTTCTACCGCCCGGACATCGTGCCGCTGAACGAGAACGAGACG
TCGAACACCTCGGAGTACAGGCTGATCAACTGCAACACCTCCGCGGTCACGCAGGCGTGCCCCAAGGTCACGTTCGAG
CCCATCCCCATCCACTACTGCGCCCCCGCCGGCTACGCCATCCTGAAGTGCAACGACGAGACCTTCAACGGGACCGGC
CCGTGCAGCAACGTGTCCACCGTGCAGTGCACGCACGGCATCCGGCCCGTGGTGTCCACGCAGCTGCTCCTGAACGGG
TCGCTGGCGGAGAAGGAGATCGTCATCCGGTCCGAGAACCTCACGAACAACGCGAAGATCATCATCGTGCACCTGAAC
GCGCCCGTGGAGATCGTGTGCACCCGCCCGAACAACGACACGCGCAAGTCCGTCCGGATCGGCCCTGGCCAGACCTTC
TACGCCACCGGCGACATCATCGGCGACATCCGGCAGGCCCACTGCAACATCAGCGAGAAGGAGTGGAACGAGACCCTG
CAGAAGGTGGGCATCGAGCTGCAGAAGCACTTCCCCAACAAGACCATTAAGTACGAGCAGTCGGCCGGCGGCGACATG
GAGATCACCACGCACTCCTTCAACTGCGGTGGCGAGTTCTTCTACTGCAACACGTCGAAGCTGTTCAACGGCACGTAC
AACGGCACCTACATCAACACGTCGTCGAACTCGACGATCACGCTCCAGTGCCGCATCAAGCAGATCATCAACATGTGG
CAGGGGGTGGGCCGCTATGTACGCACCGCCCATCGCCGGCAACATCACCTGCAAGTCCGACATCACCGGCCTCCTG
CTGACCCGCGACGGCGGCACGAACTCGAGCGGCAAGGAGGAGATCTTCAGGCCAGCGGGAGGCGACATGCGCGACAAC
TGGCGCTCCGAGCTGTACAAGTACAAGGTGGTGGAGATCCAGCCCCTGGGCATCGCACCCACCGGGGCCAAGgagCGG
GTCGTGGAGCGCGAGAAGgagGCGGCGGGCCTCGGCGCCCTGTTCCTGGGCTTCCTGGGCGCTGCGGGCTCCACCATG
GGTGCCGCGTCCATCACCCTGACCGTGCAGGCCCGCCAGCTGCTCTCCGGCATCGTGCAGCAGCAGTCCAACCTCCTG
AGGGCCATCGAGGCCCAGCAGCACATGCTGCAGCTGACCGTGTGGGGCATCAAGCAGCTGCAGGCAGGGTGCTCGCG
CTCGAGCGCTACCTGAAGGACCAGCAGCTGCTCGGCATGTGGGGCTGCTCCGGCAAGCTGATCTGCACGACCAACGTG
CCCTGGAACACGTCCTGGTCCAACAAGTCGGAGACGGACATCTGGGACAACATGACCTGGATGCAGTGGGAGCGCGAG
ATCTCCAACTACACCGAGACCATCTACAAGCTCCTCGAGGACTCCCAGAACCAGCAGGAGCGGAACGAGCAGGATCTG
CTCGCGCTGGACTCGTGGAACTCCCTGTGGAACTGGTTCAACATCACCAAGTGGCTGTGGtacatcaagTAGTAAggg
atcc

>HV1301071, CH0848.3.D0864.3.03

GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCAAGGCCTACGAGAAGGAGGTGCACAACGTGTGGGCGACCCACGCCTGCGTG
CCCACGGACCCCAGCCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACACGGTCAACAACCGCACCGTCTACGAGATGAAGAACTGCTCCTTCAACACGACGACGGAG
ATCCGCGACAAGGAGAAGAAGGAGTACGCCCTGTTCTACCGCCCGGACATCGTGCCGCTGAACGAGAACGAGACGTCG
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCAACGTGTCCACCGTGCAGTGCACGCACGGCATCCGGCCCGTGGTGTCCACGCAGCTGCTCCTGAACGGGTCG
CTGGCGGAGAAGGAGATCGTCATCCGGTCCGAGAACCTCACGAACAACGCGAAGATCATCATCGTGCAGCTGAACACG
TCGGTGGAGATCGTGTGCACCCGCCCGAACAACAACACGCGCAAGTCCGTCCGGATCGGCCCTGGCCAGACCTTCTAC
GCCACCGGCGACATCATCGGCGAGATCCGGCAGGCCCACTGCAACATCAGCGAGAAGGAGTGGAACGAGACCCTGCAG
AAGGTGGGCAAGGAGCTGCAGAAGCACTTCCCCAACAAGACCATTAAGTACGCGCAGTCGGCCGGCGGCGACATGGAG
```

Figure 7 continued

```
ATCACCACGCACTCCTTCAACTGCGGTGGCGAGTTCTTCTACTGCAACACGGCCAACCTGTTCAACGGCACGTACAAC
GGCACCGACATCTCGACGAACTCCTCGACGAAGTCGAACTCGACGATCACGCTCCAGTGCCGCATCAAGCAGATCATC
AACATGTGGCAGGGGGTGGGCCGCGCTATGTACGCACCGCCCATCGCCGGCAACATCACCTGCCGCTCCACGATCACC
GGCCTCCTGCTGACCCGCGACGGCGGCAACTCGTCGAAGACCGAGGAGGAGACGTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACG
ACCAACGTGCCCTGGAACACGTCCTGGTCCAACAAGTCGAAGACGGACATCTGGGACAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGAACTGGTTCAACATCACCAAGTGGCTGTGGtacatcaag
TAGTAAgggatcc
```

>HV1301072, CH0848.3.D0893.10.05

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCAAGGCCTACGAGAAGGAGGTGCACAACGTGTGGGCGACCCACGCCTGCGTG
CCCACGGACCCCAGCCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACACGGTCAACAACCGCACCGTCTACGAGATGAAGAACTGCTCCTTCAACACGACGACGGAG
ATCCGCGACAAGGAGAAGAAGGAGTACGCCCTGTTCTACCGCCCGGACATCGTGCCGCTGAACGAGAACGAGACGTCG
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCAACGTGTCCACCGTGCAGTGCACGCACGGCATCCGGCCCGTGGTGTCCACGCAGCTGCTCCTGAACGGGTCG
CTGGCGGAGAAGGAGATCGTCATCCGGTCCGAGAACCTCACGAACAACGCGAAGATCATCATCGTGCAGCTGAACACG
TCGGTGGAGATCGTGTGCACCCGCCCGAACAACAACACGCGCAAGTCCGTCCGGATCGGCCCTGGCCAGACCTTCTAC
GCCACCGGCGACATCATCGGCGAGATCCGGCAGGCCCACTGCAACATCAGCGAGGAGGAGTGGAACGACACCCTGCAG
AAGGTGGGCAAGGAGCTGCAGAAGCACTTCCCCAACAAGACCATTGAGTACAAGCAGTCGGCCGGCGGCGACATGGAG
ATCACCACGCACTCCTTCAACTGCGGTGGCGAGTTCTTCTACTGCAACACGGCCAAGCTGTTCAACGGGACGTACAAC
GGCACGGACATCTCCACGAACTCCTCGACGAACTCGAACCCGACGATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACC
GGCCTCCTGCTGACCCGCGACGGCGGCAACTCGTCGAAGACGGAGGAGGAGATCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACG
ACCAACGTGCCCTGGAACACGTCCTGGTCCAACAAGTCGGAGACCGACATCTGGGACAACATGACCTGGATGCAGTGG
GAGCGCGAGATCTCCAACTACACCGGGACCATCTACAAGCTCCTCGAGGACTCCCAGAACCAGCAGGAGCGGAACGAG
CAGGAGCTGCTCGCGCTGGACTCGTGGAACTCCCTGTGGAACTGGTTCAACATCACCAAGTGGCTGTGGtacatcaag
TAGTAAgggatcc
```

>HV1301073, CH0848.3.D0949.10.10

```
GgtcgacaagaaATGCGCGTGATGGGCATCCTCAAGAACTACCCGCAGTGGTGGATCTGGGGCATCCTGGGCTTCTGG
ATGCTCATGAACTGCAACggcGAGGGCAACCTCTGGGTGACGGTCTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGGACAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGGAGAACAAGACGGTGGAGGAGATGAAGAACTGCTCCTTCAACACGACGACG
GAGATCCGCGACAAGGAGAAGAAGGAGTACGCCCTGTTCTACAAGCCGGACGTCGTGCCGCTGGACGAGACGAACAAC
```

Figure 7 continued

```
ACCTCGGAGTACAGGCTGATCAACTGCAACACCTCCGCGGTCACGCAGGCGTGCCCCAAGGTCACGTTCGAGCCCATC
CCCATCCACTACTGCGCCCCCGCCGGCTACGCCATCCTGAAGTGCAACGACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGCACACGCCC
GTGGAGATCGTGTGCACCCGCCCGAACAACAACACGCGCAAGTCCGTCCGGATCGGCCCTGGCCAGACCTTCTACGCC
ACCGGCGACATCATCGGCGACATCAAGCAGGCCCACTGCAACATCAGCGAGAAGAAGTGGAACGAGACCCTGCAGAAG
GTGGGCATCGAGCTGCAGAAGCACTTCCCCAACAAGACCATTAAGTACAACCAGTCGGCCGGCGGCGACATGGAGATC
ACCACGCACTCCTTCAACTGCGGTGGCGAGTTCTTCTACTGCAACACGTCGAACCTGTTCAACGGGACGTACAACGGC
ACCTACATCTCCACGAACTCCTCGGCGAACTCGACCTCGACGATCACGCTCCAGTGCCGCATCAAGCAGATCATCAAC
ATGTGGCAGGGGGTGGGCCGCGCTATGTACGCACCGCCCATCGCCGGCAACATCACCTGCCGGTCCAACATCACCGGC
CTCCTGCTGACCCGCGACGGCGGCACCAACTCGAACGAGACGGAGACCTTCAGGCCAGCGGGAGGCGACATGCGCGAC
AACTGGCGCTCCGAGCTGTACAAGTACAAGGTGGTGGAGATCCAGCCCCTGGGCATCGCACCCACCGGGGCCAAGgag
CGGGTCGTGGAGCGCGAGA ALgagGCGGCGGGCCTCGGCGCCCTGTTCCTGGGCTTCCTGGGCGCTGCGGGCTCCACC
ATGGGTGCCGCGTCCATCACCCTGACCGTGCAGGCCCGCCAGCTGCTCTCCGGCATCGTGCAGCAGCAGTCCAACCTC
CTGAGGGCCATCGAGGCCCAGCAGCACATGCTGCAGCTGACCGTGTGGGGCATCAAGCAGCTGCAGGCCAGGGTGCTC
GCGCTCGAGCGCTACCTGAAGGACCAGCAGCTGCTCGGCATGTGGGGCTGCTCCGGCAAGCTGATCTGCACGACCAAC
GTGCCCTGGAACACGTCCTGGTCCAACAAGTCGGAGACCGACATCTGGGACAACATGACCTGGATGCAGTGGGAGCGC
GAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCTCGATCACCAAGTGGCTGTGGtacatcaagTAGTAA
gggatcc

>HV1301074, CH0848.3.D0949.10.17

GgtcgacaagaaATGCGCGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTCTACTACGGCgtgCCGGTGTGGAAGGAGGCCAAG
ACGACCCTGTTCTGCGCGTCGGACGCCCGCGCCTACGAGAAGGGAGGTGCACAACGTGTGGGCGACCCACGCCTGCGTG
CCCACGGACCCCAGCCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACGGGACGGTGGAGGAGATGAAGAACTGCTCCTTCAACACGACGACG
GAGATCCGCGACAAGGAGAAGAAGGAGTACGCCCTGTTCTACAAGCCGGACATCGTGCCGCTGTCGGAGACGAACAAC
ACCTCGGAGTACAGGCTGATCAACTGCAACACCTCCGCGGTCACGCAGGCGTGCCCCAAGGTCACGTTCGAGCCCATC
CCCATCCACTACTGCGCCCCCGCCGGCTACGCCATCCTGAAGTGCAACGACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGCACACGCCC
GTGGAGATCGTGTGCACCCGCCCGAACAACAACACGCGCAAGTCCGTCCGGATCGGCCCTGGCCAGACCTTCTACGCC
ACCGGCGACATCATCGGCGACATCAAGCAGGCCCACTGCAACATCAGCGAGGAGAAGTGGAACGACACCCTGCAGAAG
GTGGGCATCGAGCTGCAGAAGCACTTCCCCAACAAGACCATTAAGTACAACCAGTCGGCCGGCGGCGACATGGAGATC
ACCACGCACTCCTTCAACTGCGGTGGCGAGTTCTTCTACTGCAACACGTCGAACCTGTTCAACGGGACGTACAACGGC
ACCTACATCTCCACGAACTCCTCGGCGAACTCGACCTCGACGATCACGCTCCAGTGCCGCATCAAGCAGATCATCAAC
ATGTGGCAGGGGGTGGGCCGCGCTATGTACGCACCGCCCATCGCCGGCAACATCACCTGCCGGTCCAACATCACCGGC
CTCCTGCTGACCCGCGACGGCGGCACCAACTCGAACGAGACGGAGACCTTCAGGCCAGCGGGAGGCGACATGCGCGAC
AACTGGCGCTCCGAGCTGTACAAGTACAAGGTGGTGGAGATCCAGCCCCTGGGCATCGCACCCACCGGGGCCAAGgag
CGGGTCGTGGAGCGCGAGAAGgagGCGGCGGGCCTCGGCGCCCTGTTCCTGGGCTTCCTGGGCGCTGCGGGCTCCACC
ATGGGTGCCGCGTCCATCACCCTGACCGTGCAGGCCCGCCAGCTGCTCTCCGGCATCGTGCAGCAGCAGTCCAACCTC
CTGAGGGCCATCGAGGCCCAGCAGCACATGCTGCAGCTGACCGTGTGGGGCATCAAGCAGCTGCAGGCCAGGGTGCTC
GCGCTCGAGCGCTACCTGAAGGACCAGCAGCTGCTCGGCATGTGGGGCTGCTCCGGCAAGCTGATCTGCACGACCAAC
GTGCCCTGGAACACGTCCTGGTCCAACAAGTCGGAGACCGACATCTGGGACAACATGACCTGGATGCAGTGGGAGCGC
GAGATCTCCAACTACACCGAGACCATCTACAAGCTCCTCGAGGACTCCCAGAACCAGCAGGAGCGGAACGAGCAGGAT
CTGCTCGCGCTGGACTCGTGGAACTCCCTGTGGAACTGGTTCTCGATCACCAAGTGGCTGTGGtacatcaagTAGTAA
gggatcc

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCCGCGCCTACGAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCGAGGAGATGAAGAACTGCTCCTTCAACACGACGACG
GAGATCCGCGACAAGGAGAAGAAGGAGTACGCCCTGTTCTACAAGCCGGACGTGGTGCCGCTGGACGAGACGAACAAC
ACCTCGGAGTACAGGCTGATCAACTGCAACACCTCCGCGGTCACGCAGGCGTGCCCCAAGGTCACGTTCGAGCCCATC
CCCATCCACTACTGCGCCCCGCCGGCTACGCCATCCTGAAGTGCAACAACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGAACACGCCC
GTGGAGATCGTGTGCACCCGCCCGAACAACAACACGCGCAAGTCCGTCCGGATCGGCCCTGGCCAGACCTTCTACGCC
ACCGGCGACATCATCGGCGACATCCGGCAGGCCCACTGCAACATCAGCGAGAAGCAGTGGAACGACACCCTGCAGAAG
GTGGGCAAGGAGCTGAAGAAGCACTTCCCCAACAAGACCATTAAGTACGCGCAGTCGGCCGGCGGCGACATGGAGATC
ACCACGCACTCCTTCAACTGCGGTGGCGAGTTCTTCTACTGCAACACGGCGAAGCTGTTCAACGGCACGTACAACGGC
ACCGACATCTCGACGAACTCGTCCGCGGACTCGAACTCGACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCCACATCACCGGC
CTCCTGCTGACCCGCGACGGCGGCACGAACTCGAGCGGCAAGGAGGAGATCTTCAGGCCAGCGGGAGGCGACATGCGC
GACAACTGGCGCTCCGAGCTGTACAAGTACAAGGTGGTGGAGATCCAGCCCCTGGGCATCGCACCCACCGGGGCCAAG
gagCGGGTCGTGGAGCGCGAGAAGgagGCGGCGGGCCTCGGCGCCCTGTTCCTGGGCTTCCTGGGCGCTGCGGGCTCC
ACCATGGGTGCCGCGTCCATCACCCTGACCGTGCAGGCCCGCCAGCTGCTCTCCGGCATCGTGCAGCAGCAGTCCAAC
CTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACC
AACGTGCCCTGGAACACGTCCTGGTCCAACAAGTCGGAGACGGACATCTGGGACAACATGACCTGGATGCAGTGGGAG
CGCGAGATCTCCAACTACACCGAGACCATCTACAAGCTCCTCGAGGACTCCCAGAACCAGCAGGAGCGGAACGAGCAG
GATCTGCTCGCGCTGGACTCGTGGAACTCCCTGTGGAACTGGTTCAACATCACCAAGTGGCTGTGGtacatcaagTAG
TAAgggatcc
```

>HV1301076, CH0848.3.D0780.15.22

```
GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCCGCGCCTACGAGAAGGAGGTGCACAACGTGTGGGCGACCCACGCCTGCGTG
CCCACGGACCCCAACCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCGAGGAGATGAAGAACTGCTCCTTCAACACGACGACG
GAGATCCGCGACAAGGAGAAGAAGGAGTACGCCCTGTTCTACAAGCCGGACGTGGTGCCGCTGGACGAGACGAACAAC
ACCTCGGAGTACAGGCTGATCAACTGCAACACCTCCGCGGTCACGCAGGCGTGCCCCAAGGTCACGTTCGAGCCCATC
CCCATCCACTACTGCGCCCCGCCGGCTACGCCATCCTGAAGTGCAACAACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGAACACGCCC
GTGGAGATCGTGTGCACCCGCCCGAACAACAACACGCGCAAGTCCGTCCGGATCGGCCCTGGCCAGACCTTCTACGCC
ACCGGCGACATCATCGGCGACATCCGGCAGGCCCACTGCAACATCAGCGAGAAGCAGTGGAACGACACCCTGCAGAAG
GTGGGCAAGGAGCTGAAGAAGCACTTCCCCAACAAGACCATAAAGTACGCGCAGTCGGCCGGCGGCGACATGGAGATC
ACCACGCACTCCTTCAACTGCGGTGGCGAGTTCTTCTACTGCAACACGGCGAAGCTGTTCAACGGCACGTACAACGGC
ACCGACATCTCGACGAACTCGTCCGCCGACTCGAACAGCACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCCACATCACCGGC
CTCCTGCTGACCCGCGACGGCGGCACGAACTCGAGCGGCAAGGAGGAGATCTTCAGGCCAGCGGGAGGCGACATGCGC
GACAACTGGCGCTCCGAGCTGTACAAGTACAAGGTGGTGGAGATCCAGCCCCTGGGCATCGCACCCACCGGGGCCAAG
gagCGGGTCGTGGAGCGCGAGAAGgagGCGGCGGGCCTCGGCGCCCTGTTCCTGGGCTTCCTGGGCGCTGCGGGCTCC
ACCATGGGTGCCGCGTCCATCACCCTGACCGTGCAGGCCCGCCAGCTGCTCTCCGGCATCGTGCAGCAGCAGTCCAAC
CTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACC
AACGTGCCCTGGAACACGTCCTGGTCCAACAAGTCGGAGAAGGACATCTGGGACAACATGACCTGGATGCAGTGGGAG
```

Figure 7 continued

CGCGAGATCTCCAACTACACCGAGACCATCTACAAGCTCCTCGAGGACTCCCAGAACCAGCAGGAGCGGAACGAGAAG
GATCTGCTCGCGCTGGACTCGTGGAACTCCCTGTGGAACTGGTTCAACATCACCAAGTGGCTGTGGtacatcaagTAG
TAAgggatcc

>HV1301077, CH0848.3.D0780.15.29

GgtcgacaagaaATGCGGGTGATGGGCATCCCCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAACCCGCAGGAGCTCGTGCTGGGCAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCGAGGAGATGAAGAACTGCTCCTTCAACACGACGACG
GAGATCCGCGACAAGGAGAAGAAGGAGTACGCCCTGTTCTACAAGCCGGACGTGGTGCCGCTGGACGAGACGAACAAC
ACCTCGGAGTACAGGCTGATCAACTGCAACACCTCCGCGGTCACGCAGGCGTGCCCCAAGGTCACGTTCGAGCCCATC
CCCATCCACTACTGCGCCCCCGCCGGCTACGCCATCCTGAAGTGCAACAACGAGACCTTCAACGGGACCGGCCCGTGC
AGCAACGTGTCCACCGTGCAGTGCACGCACGGCATCCGGCCCGTGGTGTCCACGCAGCTGCTCCTGAACGGGTCGCTG
GCGGAGAAGGAGATCGTCATCCGGTCCGAGAACCTCACGAACAACGCGAAGATCATCATCGTGCACCTGAACACGCCC
GTGGAGATCGTGTGCACCCGCCCGAACAACAACACGCGCAAGTCCGTCCGGATCGGCCCTGGCCAGACCTTCTACGCC
ACCGGCGACATCATCGGCGACATCCGGCAGGCCCACTGCAACATCAGCGAGAAGCAGTGGAACGACACCCTGCAGAAG
GTGGGCAAGGAGCTGAAGAAGCACTTCCCCAACAAGACCATTAAGTACGCGCAGTCGGCCGGCGGCGACATGGAGATC
ACCACGCACTCCTTCAACTGCGGTGGCGAGTTCTTCTACTGCAACACGGCGAAGCTGTTCAACGGCACGTACAACGGC
ACCGACATCTCGACGAACTCGTCCGCCGACTCGAACAGCACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCCACATCACCGGC
CTCCTGCTGACCCGCGACGGCGGCACGAACTCGAGCGAGAAGGAGGAGATCTTCAGGCCAGCGGGAGGCGACATGCGC
GACAACTGGCGCTCCGAGCTGTACAAGTACAAGGTGGTGGAGATCCAGCCCCTGGGCATCGCACCCACCGGGGCCAAG
gagcGGGTCGTGGAGCGCGAGAAGgagGCGGCGGGCCTCGGCGCCCTGTTCCTGGGCTTCCTGGGCGCTGCGGGCTCC
ACCATGGGTGCCGCGTCCATCACCCTGACCGTGCAGGCCCGCCAGCTGCTCTCCGGCATCGTGCAGCAGCAGTCCAAC
CTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACC
AACGTGCCCTGGAACACGTCCTGGTCCAACAAGTCGGAGAAGGACATCTGGGACAACATGACCTGGATGCAGTGGGAG
CGCGAGATCTCCAACTACACCGAGACCATCTACAAGCTCCTCGAGGACTCCCAGAACCAGCAGGAGCGGAACGAGAAG
GATCTGCTCGCGCTGGACTCGTGGAACTCCCTGTGGAACTGGTTCAACATCACCAAGTGGCTGTGGtacatcaagTAG
TAAgggatcc

>HV1301078, CH0848.3.D0808.15.43

GgtcgacaagaaATGCGGGTGATGGGCATCCTCAAGAACTACCCGCAGTGGTGGATCTGGGGCATCCTGGGCTTCTGG
ATGCTCATGATCTGCAACggcAAGGGCAAGCTCTGGGTGACGGTGTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACCTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAAGAACCGCACCGTCGAGGAGATGAAGAACTGCTCCTTCAACACGACGACG
GAGATCCGCGACAAGGAGAAGAAGGAGTACGCCCTGTTCTACCGCCCGGACATCGTGCCGCTGAACGAGAACGAGACG
TCGAACACCTCGGAGTACAGGCTGATCAACTGCAACACCTCCGCGGTCACGCAGGCGTGCCCCAAGGTCACGTTCGAG
CCCATCCCCATCCACTACTGCGCCCCCGCCGGCTACGCCATCCTGAAGTGCAACAACGAGACCTTCAACGGGACCGGC
CCGTGCAGCAACGTGTCCACCGTGCAGTGCACGCACGGCATCCGGCCCGTGGTGTCCACGCAGCTGCTCCTGAACGGG
TCGCTGGCGGAGAAGGAGATCGTCATCCGGTCCGAGAACCTCACGAACAACGCGAAGATCATCATCGTGCACCTGCAC
ACGCCCGTGGAGATCGTGTGCACCCGCCCGAACAACAACACGCGCAAGTCCGTCCGGATCGGCCCTGGCCAGACCTTC
TACGCCACCGGCGACATCATCGGCGACATCCGGCAGGCCCACTGCAACATCAGCGAGAAGCAGTGGAACGACACCCTG
CAGAAGGTGGGCAAGGAGCTGCAGAAGCACTTCCCCAACAAGACCATTAAGTACAAGCACTCGGCCGGCGGCGACATG
GAGATCACCACGCACTCCTTCAACTGCGGTGGCGAGTTCTTCTACTGCAACACGTCGAACCTGTTCAACGGCACGTAC
AACGGCACCTACATGAACATCTCGACGGACTCGAACTCGACGATCACGCTCCAGTGCCGCATCAAGCAGATCATCAAC
ATGTGGCAGGGGGTGGGCCGCGCTATGTACGCACCGCCCATCGCCGGCAACATCACCTGCAAGTCCCACATCACCGGC

Figure 7 continued

CTCCTGCTGACCCGCGACGGCGGCACGAACTCGAGCGGCAAGGAGGAGATCTTCAGGCCAGCGGGAGGCGACATGCGC
GACAACTGGCGCTCCGAGCTGTACAAGTACAAGGTGGTGGAGATCCAGCCCCTGGGCATCGCACCCACCGGGGCCAAG
gagCGGGTCGTGGAGCGCGAGAAGgagGCGGCGGGCCTCGGCGCCCTGTTCCTGGGCTTCCTGGGCGCTGCGGGCTCC
ACCATGGGTGCCGCGTCCATCACCCTGACCGTGCAGGCCCGCCAGCTGCTCTCCGGCATCGTGCAGCAGCAGTCCAAC
CTCCTGAGGGCCATCGAGGCCCAGCAGCACATGCTGCAGCTGACCGTGTGGGGCATCAAGCAGCTGCAGGCCAGGGTG
CTCGCGCTCGAGCGCTACCTGAAGGACCAGCAGCTGCTCGGCATGTGGGGCTGCTCCGGCAAGCTGATCTGCACGACC
AACGTGCCCTGGAACACGTCCTGGTCCAACAAGTCGGAGACGGACATCTGGGACAACATGACCTGGATGCAGTGGGAG
CGCGAGATCTCCAACTACACCGAGACCATCTACAAGCTCCTCGAGGACTCCCAGAACCAGCAGGAGCGGAACGAGCAG
GATCTGCTCGCGCTGGACTCGTGGAACTCCCTGTGGAACTGGTTCAACATCACCAAGTGGCTGTGGtacatcaagTAG
TAAgggatcc

>HV1301079, CH0848.3.D1120.10.05

GgtcgacaagaaATGCGCGTGATGGGCATCCCCAAGAACTACCCGCAGTGGTGGATCTGGGGCATCCTGGGCTTCTGG
ATGCTCATGAACTGCAACggcGAGGGCAACCTCTGGGTGACGGTCTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGACGGCCACGGTGAACAAGTCCACGGTGGAGGAGATGAAGAACTGCTCCTTCAACACGACGACG
GAGATCCGCGACAAGGAGAAGAAGGAGTACGCCCTGTTCTACCGCCCGGACATCGTGCCGCTGAACAACAAGACGTCG
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCAACGTGTCCACCGTGCAGTGCACGCACGGCATCCGGCCCGTGGTGTCCACGCAGCTGCTCCTGAACGGGTCG
CTGGCGGAGGAGGAGATCGTCATCCGGTCCGAGAACCTCACGAACAACGCGAAGATCATCATCGTGCACCTGCACACG
CCCGTGGAGATCGTGTGCACCCGCCCGAACAACAACACGCGCAAGTCCGTCCGGATCGGCCCTGGCCAGACCTTCTAC
GCCACCGGCGGCATCATCGGCGACGTGCGCCAGGCCCACTGCAACATCAGCAAGGGCCTCTGGAACGACACCCCTGCAG
AAGGTGGGCAAGGAGCTGCAGAAGCACTTCCCCAACAAGACCATTCGCTACAACCAGTCGGCCGGCGGCGACATGGAG
ATCACCACGCACTCCTTCAACTGCGGTGGCGAGTTCTTCTACTGCAACACGGCCAAGCTGTTCAACGGGACGTACAAC
GGCACCGACATCTCCACGAACTCCTCGGCGAACAACTCGTCCACGATCACGCTCCAGTGCCGCATCAAGCAGATCATC
AACATGTGGCAGGGGGTGGGCCGCGCTATGTACGCACCGCCCATCGCCGGCAACATCACCTGCAAGTCCAACATCACC
GGCCTCCTGCTGACCCGCGACGGCGGCATCAACTCGTCGCGCGAGGAGGAGATCTTCAGGCCAGCGGGAGGCGACATG
CGCGACAACTGGCGCTCCGAGCTGTACAAGTACAAGGTGGTGGAGGTGCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATGTGGGGCTGCTCCGGCAAGCTGATCTGCACG
ACCAACGTGCCCTGGAACACGTCCTGGTCCAACAAGTCGGAGATGGACATCTGGGACAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGAACTGGTTCAACATCACCAAGTGGCTGTGGtacatcaag
TAGTAAgggatcc

>HV1301080, CH0848.3.D1432.5.06

GgtcgacaagaaATGCGCGTGATGGGCATCCCCAAGAACTACCCGCGCTGGTGGATCTGGGGCATCCTGGGCTTCTGG
ATGCTCATGATCTGCAACggcAAGGGCAAGCTCTGGGTGACGGTCTACTACGGCgtgCCGGTGTGGAAGGAGGCCAAG
ACGACCCTGTTCTGCGCGTCGGACGCCAAGGCCTACGTGAAGGAGGTGCACAACGTGTGGGCGACCCACGCCTGCGTG
CCCACGGACCCCAGCCCGCAGGAGCTCCTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGGAGAACTCGACGACGGACGAGATGAAGAACTGCTCCTTCAACACGACGACG
GAGATCCGCGACAAGGAGAAGAAGGAGCGCGCCCTGTTCTACCGCCCGGACATCGTGCCGCTGAACAACGAGACGGGC
AACACCTCGGAGTACAGGCTGATCAACTGCAACACCTCCGCGATCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCTCGGTGTCCACCGTGCAGTGCACGCACGGCATCCGGCCCGTGGTGTCCACGCAGCTGCTCCTGAACGGGTCG

Figure 7 continued

```
CTGGCGGAGAAGGGGATCGTCATCCGGTCCGAGAACCTCACGAACAACGCGAAGATCATCATCGTGCACCTGAACGCC
TCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGCCAGGCCCACTGCAACATCAGCGAGAAGAAGTGGAACGAGACCCTGCAG
AAGGTGGGCATCGAGCTGCAGAAGCACTTCCCCAACAAGACCATTAAGTACAACCAGTCGGCCGGCGGCGACATGGAG
ATCACCACGCACTCCTTCAACTGCGGTGGCGAGTTCTTCTACTGCAACACGGCCAAGCTGTTCAACTCGACGTACAAC
GGCACCTACATCTCCACGAACTCCATCAACTCGACCCTGAACATCACGCTCCAGTGCCGCATCAAGCAGATCATCAAC
ATGTGGCAGGGGGTGGGCCGCGCTATGTACGCACCGCCCATCGCCGGCAACATCACCTGCCGGTCCAACATCACCGGC
CTCCTGCTGACCCGCGACGGCGGCATCCACAACGACTCGAACGAGACGGAGACCTTCAGGCCAGCGGGAGGCGACATG
CGCGACAACTGGCGCTCCGAGCTGTACAAGTACAAGGTGGTGGAGGTGCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATCTGGGGCTGCTCCGGCAAGCTGATCTGCACG
ACCAACGTGCCCTGGAACACGTCCTGGTCCAACAAGTCGGAGACCGACATCTGGGGCAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGTCGTGGTTCAACATCACCAAGTGGCTGTGGtacatcaag
TAGTAAgggatcc

>HV1301081, CH0848.3.D1432.5.48

GgtcgacaagaaATGCGCGTGATGGGCATCCCCAAGAACTACCCGCGCTGGTGGATCTGGGGCATCCTGGGCTTCTGG
ATGCTCATGATCTGCAACggcAAGGGCAAGCTCTGGGTGACGGTCTACTACGGCgtgCCGGTGTGGAAGGAGGCCAAG
ACGACCCTGTTCTGCGCGTCGGACGCCAAGGCCTACGTGAAGGAGGTGCACAACGTGTGGGCGACCCACGCCTGCGTG
CCCACGGACCCCAGCCCGCAGGAGCTCCTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGGAGAACTCGACGCGGACGAGATGAAGAACTGCTCCTTCAACACGACGACG
GAGATCCGCGACAAGGAGAAGAAGGAGCGCGCCCTGTTCTACCGCCCGGACATCGTGCGCTGAACAACGAGACGGGC
AACACCTCGGAGTACAGGCTGATCAACTGCAACACCTCCGCGATCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCTCGGTGTCCACCGTGCAGTGCACGCACGGCATCCGGCCCGTGGTGTCCACGCAGCTGCTCCTGAACGGGTCG
CTGGCGGAGAAGGGGATCGTCATCCGGTCCGAGAACCTCACGAACAACGCGAAGATCATCATCGTGCACCTGAACGCC
TCCGTGGAGATCGTGTGCACCCGCCCGAACAACAACACGCGCAAGTCCGTCCGGATCGGCCCTGGCCAGACCTTCTAC
GCCACCGGCGACATCATCGGCGACATCCGCCAGGCCCACTGCAACATCAGCGAGAAGAAGTGGAACGAGACCCTGCAG
AAGGTGGGCATCGAGCTGCAGAAGCACTTCCCCAACAAGACCATTAAGTACAACCAGTCGGCCGGCGGCGACATGGAG
ATCACCACGCACTCCTTCAACTGCGGTGGCGAGTTCTTCTACTGCAACACGGCCAAGCTGTTCAACTCGACGTACAAC
GGCACCTACATCTCCACGAACTCCATCAACTCGACCCTGAACATCACGCTCCAGTGCCGCATCAAGCAGATCATCAAC
ATGTGGCAGGGGGTGGGCCGCGCTATGTACGCACCGCCCATCGCCGGCAACATCACCTGCCGGTCCAACATCACCGGC
CTCCTGCTGACCCGCGACGGCGGCATCCACAACGACTCGAACGAGACGGAGACCTTCAGGCCAGCGGGAGGCGACATG
CGCGACAACTGGCGCTCCGAGCTGTACAAGTACAAGGTGGTGGAGATCCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGCTACCTGAAGGACCAGCAGCTGCTCGGCATCTGGGGCTGCTCCGGCAAGCTGATCTGCACG
ACCAACGTGCCCTGGAACACGTCCTGGTCCAACAAGTCGGAGACCGACATCTGGGGCAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGTCGTGGTTCAACATCACCAAGTGGCTGTGGtacatcaag
TAGTAAgggatcc

>HV1301082, CH0848.3.D1432.5.35

GgtcgacaagaaATGCGCGTGATGGGCATCCCCAAGAACTACCCGCGCTGGTGGATCTGGGGCATCCTGGGCTTCTGG
ATGCTCATGATCTGCAACggcAAGGGCAAGCTCTGGGTGACGGTCTACTACGGCgtgCCGGTGTGGAAGGAGGCCAAG
ACGACCCTGTTCTGCGCGTCGGACGCCAAGGCCTACGTGAAGGAGGTGCACAACATCTGGGCGACCCACGCCTGCGTG
```

Figure 7 continued

```
CCCACGGACCCCAGCCCGCAGGAGCTCCTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCACGGTGAACCAGTCCACGACGGAGGAGATGAAGAACTGCTCCTTCAACACGACGACG
GAGATCCGCGACAAGGAGAAGAAGGAGCACGCCCTGTTCTACCGCCCGGACATCGTGCCGCTGGACAACGAGACGGGC
AACACCTCGGAGTACAGGCTGATCAACTGCAACACCTCCGCGGTCACGCAGGCGTGCCCCAAGGTCACGTTCGAGCCC
ATCCCCATCCACTACTGCGCCCCCGCCGGCTACGCCATCCTGAAGTGCAACGACGAGACCTTCAACGGGACCGGCCCG
TGCAGCAAGGTGTCCACCGTGCAGTGCACGCACGGCATCCGGCCCGTGGTGTCCACGCAGCTGCTCCTGAACGGGTCG
CTGGCGGAGAAGGGGATCGTCGTGCGGTCCGAGAACCTCACGAACAACGCGAAGATCATCATCGTGCAGCTGAACGCC
TCCGTGGAGATCGTGTGCACCCGCCCGAACAACAACACGCGCAAGTCCGTCCGGATCGGCCCTGGCCAGACCTTCTAC
GCCACCGGCGACATCATCGGCAACATCCGCCAGGCCCACTGCAACATCAGCGAGAAGAAGTGGAACGAGACCCTGCAG
AAGGTGGGCATCGAGCTGCAGAAGCACTTCCCCAACAAGACCATTAAGTACAACCAGTCGGCCGGCGGCGACATGGAG
ATCCACCACGCACTCCTTCAACTGCGGTGGCGAGTTCTTCTACTGCAACACGGCCAAGCTGTTCAACTCGACGTACAAC
GGCACCTACATCTCCACGAACTCCATCAACTCGACCCTGAACATCACGCTCCAGTGCCGCATCAAGCAGATCATCAAC
ATGTGGCAGGGGGTGGGCCGCGCTATGTACGCACCGCCCATCGCCGGCAACATCACCTGCCGGTCCAACATCACCGGC
CTCCTGCTGACCCGCGACGGCGGCATCCACAACGACTCGAACGAGACGGAGACCTTCAGGCCAGCGGGAGGCGACATG
CGCGACAACTGGCGCTCCGAGCTGTACAAGTACAAGGTGGTGGAGGTGCAGCCCCTGGGCATCGCACCCACCGGGGCC
AAGgagCGGGTCGTGGAGCGCGAGAAGgagGCGGCGGGCCTCGGCGCCCTGTTCCTGGGCTTCCTGGGCGCTGCGGGC
TCCACCATGGGTGCCGCGTCCATCACCCTGACCGTGCAGGCCCGCCAGCTGCTCTCCGGCATCGTGCAGCAGCAGTCC
AACCTCCTGAGGGCCATCGAGGCCCAGCAGCACATGCTGCAGCTGACCGTGTGGGGCATCAAGCAGCTGCAGGCCAGG
GTGCTCGCGCTCGAGCGTACCTGAAGGACCAGCAGCTGCTCGGCATCTGGGGCTGCTCCGGCAAGCTGATCTGCACG
ACCAACGTGCCCTGGAACACGTCCTGGTCCAACAAGTCGGAGACCGACATCTGGGAGAACATGACCTGGATGCAGTGG
GAGCGCGAGATCTCCAACTACACCGAGACCATCTACAAGCTCCTCGAGGACTCCCAGAACCAGCAGGAGCGGAACGAG
CAGGATCTGCTCGCGCTGGACTCGTGGAACTCCCTGTGGTCGTGGTTCAACATCACCAAGTGGCTGTGGtacatcaag
TAGTAAgggatcc
```

```
>HV1301083, CH0848.3.D1651.10.07

GgtcgacaagaaATGCGCGTGATGGGCATCCCGAAGAACTACCCGCTCTGGTGGATCTGGGGCATCCTGGGCTTCTGG
ATGCTCATGAACTGCAACggcGAGGGCAACCTCTGGGTGACGGTCTACTACGGCgtgCCGGTGTGGAAGGAGGCCAAG
ACGACCCTGTTCTGCGCGTCGGACGCCAAGGCCTACGTGAAGGAGGTGCACAACGTGTGGGCGACCCACGCCTGCGTG
CCCACGGACCCCTCGCCGCAGGAGCTGGTCCTGGACAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGAACTGCTCGAACGCCATCGTCAAGAACTCCACGACCGAGGAGATCTCCCACGCCCTCGCGCGGAACTCGACC
ACCGAGGAGATGAAGAACTGCTCCTTCAACACCACGACGGAGATCCGCGACAAGGAGAAGAAGGAGTACGCCCTGTTC
TACCGCCCCGACATCGTGCCGCTGAACAACAAGACGTCCAACATCTCCGAGTACAGGCTGATCAACTGCAACACCTCC
ACCGTCACGCAGGCGTGCCCCAAGGTCACGTTCGAGCCCATCCCATCCACTACTGCGCCCCGGCTACGCCATC
CTGAAGTGCAACGACGAGACCTTCAACGGGACCGGCCCGTGCAGCAACGTGTCCACCGTGCAGTGCACGCACGGCATC
CGGCCCGTGGTGTCCACGCAGCTGCTCCTGAACGGGTCGCTGGCGGAGAAGGGCATCGTCATCCGGTCCGAGAACCTC
ACGAACAACGCGAAGATCATCATCGTGCAGCTGAACGCCAACGCCTCGGTGGAGATCGTGTGCACCCGCCCGAACAAC
AACACGCGCAAGTCCGTGCGGATCGGCCCTGGCCAGACCTTCTACGCCACCGGCGACATCATCGGCAACATCCGGCAG
GCCCACTGCAACATCTCGGAGAAGAAGTGGAACGAGACCCTGCAGAAGGTGGGCATCGAGCTGCAGAAGCACTTCCCC
AACAAGACCATCAAGTACAACCAGTCCGCCGGCGGCGACATGGAGATCACCACGCACTCCTTCAACTGCGGTGGCGAG
TTCTTCTACTGCAACACGGCCAAGCTGTTCAACTCCACGTACAACGGCACCTACATCTCCACGAACTCGATCAACTCG
ACGCTGAACATCACGCTCCAGTGCCGGATCAAGCAGATCATCAACATGTGGCAGGGGGTGGGCCGCGCTATGTACGCA
CCGCCCATCGCCGGCAACATCACCTGCCGGTCCAACATCACCGGCCTCCTGCTGACCCGCGACGGCGGCATCCACAAC
GACTCCAACGTGACGGAGACCTTCAGGCCAGCGGGAGGCGACATGCGGGACAACTGGCGCTCCGAGCTGTACAAGTAC
AAGGTGGTGGAGATCCAGCCCCTGGGCATCGCACCCACCGGGGCCAAGgagCGGGTCGTGGAGCGCGGGAAGgagGCG
GCCGGCCTCGGCGCCCTGTTCCTGGGCTTCCTGGGCGCTGCGGGCTCCACCATGGGTGCCGCGTCCATCACCCTGACC
GTGCAGGCCCGCCAGCTGCTCTCCGGCATCGTGCAGCAGCAGTCCAACCTCCTGAGGGCCATCGAGGCCCAGCAGCAC
ATGCTGCAGCTGACCGTGTGGGGCATCAAGCAGCTGCAGGCCAGGGTGCTGGCGCTCGAGCGCTACCTGAAGGACCAG
CAGCTGCTCGGCATCTGGGGCTGCTCCGGCAAGCTGATCTGCACGACCAACGTGCCCTGGAACACGTCCTGGTCCAAC
AAGTCGGAGATGGACATCTGGAACAACATGACCTGGATGCAGTGGGAGCGCGAGATCTCCAACTACACCGGGACCATC
TACAAGCTCCTCGAGGACTCCCAGAACCAGCAGGAGCGGAACGAGCAAGACCTGCTCGCGCTGGACTCGTGGAACTCG
CTGTGGAACTGGTTCGACATCACCAAGTGGCTGTGGtacatcaagTAGTAAgggatcc
```

```
GgtcgacaagaaATGCGCGTGATGGGCATCCTCAAGAACTACCCGCAGTGGTGGATCTGGGGCATCCTGGGCTTCTGG
ATGCTCATGAACTGCAACggcGAGGGCAACCTCTGGGTGACGGTCTACTACGGCgtgCCGGTGTGGAAGGAGGCCAAG
ACGACCCTGTTCTGCGCGTCGGACGCCAAGGCCTACAAGAAGGAGGTGCACAACGTGTGGGCGACCCACGCCTGCGTG
CCCACGGACCCCAGCCCGCAGGAGCTCTTCCTGAAGAACGTGACCGAGAACTTCAACATGTGGAAGAACGACATGGTG
GACCAGATGCACGAGGACATCATCTCCCTGTGGGACCAGTCCCTGAAGCCCTGCGTGAAGCTGACCCCGCTGTGCGTG
ACCCTGATCTGCTCGAACGCCATCGTGAAGAACTCGACGACCGAGGAGATGTCCAACGCCACGGTGAAGAACTCGACG
ACGGAGGAGATGAAGAACTGCTCCTTCAACACGACGACGGAGATCCGCGACAAGGAGAAGAAGGAGTACGCCCTGTTC
TACCGCCCGGACGTGGTCCCGCTGGACGAGACGAACAACACCTCGAAGTACAGGCTGATCAACTGCAACACCTCCGCG
GTGACGCAGGCGTGCCCCAAGGTCACGTTCGAGCCCATCCCCATCCACTACTGCGCCCCCGCCGGCTACGCCATCCTG
AAGTGCAACGACGAGACCTTCAACGGGACCGGCCCGTGCAGCAACGTGTCCACCGTGCAGTGCACGCACGGCATCCGG
CCCGTGGTGTCCACGCAGCTGCTCCTGAACGGGTCGCTGGCGGAGAAGGAGATCGTCATCCGGTCCGAGAACCTCACG
AACAACGCGAAGACGATCATCGTGCACCTGCACACCCCGGTGGAGATCGTGTGCACCCGCCCGTACAACAACACGCGC
AAGTCCGTCCGGATCGGCCCTGGCCAGACCTTCTACGCCACCGGCGACATCATCGGCGACCCGCGCCAGGCCCACTGC
AACATCAGCAAGGAGACCTGGAACAAGACCCTGCAGGAGGTGGGCAAGGAGCTGCAGAAGCACTTCCCCAACAAGACC
ATTCGCTACAACCAGTCGGCCGGCGGCGACATGGAGATCACCACGCACTCCTTCAACTGCGGTGGCGAGTTCTTCTAC
TGCAACACGTCCAACCTGTTCAACTCGACGTACAACGACACCTACATCTCCCCGAACTCCACCAACTCGACCTCGACG
ATCACGCTCCAGTGCCGCATCAAGCAGATCATCAACATGTGGCAGGGGTGGGCCGCGCTATGTACGCACCGCCCATC
GCCGGCAACATCACCTGCAAGTCCAACATCACCGGCCTCCTGCTGACCCGCGACGGCGGCACGACCAACAACTCGAAC
GAGACGGAGACCTTCAGGCCAGCGGGAGGCGACATGCGCGACAACTGGCGCTCCGAGCTGTACAAGTACAAGGTGGTG
GAGGTCCAGCCCCTGGGCCTCGCACCCACCGGGGCCAAGgagCGGGTCGTGGAGCGCGAGAAGgagGCGGCGGGCCTC
GGCGCCCTGTTCCTGGGCTTCCTGGGCGCTGCGGGCTCCACCATGGGTGCCGCGTCCATCACCCTGACCGTGCAGGCC
CGCCAGCTGCTCTCCGGCATCGTGCAGCAGCAGTCCAACCTCCTGAGGGCCATCGAGGCCCAGCAGCACATGCTGCAG
CTGACCGTGTGGGGCATCAAGCAGCTGCAGGCCAGGGTGCTCGCGCTCGAGCGCTACCTGAAGGACCAGCAGCTGCTC
GGCATCTGGGGCTGCTCCGGCAAGCTGATCTGCACGACCAACGTGCCCTGGAACACGTCCTGGTCCAACAAGTCGGAG
ATGGACATCTGGGGCAACATGACCTGGATGCAGTGGGAGCGCGAGATCTCCAACTACACCGGGACCATCTACAAGCTC
CTCGAGGACTCCCAGAACCAGCAGGAGCGGAACGAGCAGGATCTGCTCGCGCTGGACTCGTGGAACAACCTGTGGAAC
TGGTTCTCCATCACCAAGTGGCTGTGGtacatcaagTAGTAAgggatcc*
```

Figure 8 (sequence of CH848gp140C constructs)

>HV1300815_CH848.3.d0078.30.02gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYKPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEKQWNKTLQEVGKELQKHFPNKTIKYERSAGGDMEIATHSFNCG
GEFFYCNTSNLFNGTYNGTYISTHSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GIX

>HV1300816_CH848.3.d0078.30.42gp140C

MRVMGILKNYPQWWIWGILGFWMLMICNGKGNLWVTVYYGVPVWKEAKTTLFCASNAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GDRIR
DPDX

>HV1300817_CH848.3.d0107.30.12gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISANSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GHRIR
DPDXX

>HV1300818_CH848.3.d0107.30.27gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEKQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GNRIR
DPDXX

>HV1300819_CH848.3.d0107.30.31gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN

Figure 8 continued

TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWSKTLQEVGKELQKHFPNKTIKYERSAGGDMEIATHSFNCG
GEFFYCNTSNLFNGTYNGTYISANSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GYRIR
DPDX

>HV1300820_CH848.3.d0135.27.03gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GDRIR
VPDX

>HV1300821_CH848.3.d0135.27.06gp140C

MRVMGILKNYPQWWIWGILGFWMLMICNGKGKLWVTVYYGVPVWKEAKTTLFCASDAKAYEKEVHNVWATHACVPTD
PSPQELGLENVTENFNMWKNDMVDQMHEDIISLWDQSLKPCVKLTPLCVTLKCSNAIVDSSKVYDTRSKVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKGIVIRSENLTNNAKIIIVQLNTSVEIVCTRPG
NNTRKSVRIGPGQTFYATGDIIGDIRQAHCNISEWQWNKTLHEVGKELQKHFPNKTIKYERSAGGDMEIATHSFNCG
GEFFYCNTSNLFNGTYNGTYINTSSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWDTN
WSNKSEKDIWDNMTWMQWEREISNYTETIYKLLEDSQHQQERNEQDLLALDSWNSLWNWFNITNWLWYIK**GDRIQ
DPDX

>HV1300822_CH848.3.d0135.60.05gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISESQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLPAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GDRIQ
VPDX

>HV1300823_CH848.3.d0135.60.14gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEWQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGHITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS

Figure 8 continued

WSNKSEKDIWDNMTWMQWEREISNYTETIYMLLEDSQHQQERNEKDLLALDSWNSLWNWFNITNWLWYIR**GDRIR
DLDX

>HV1300824_CH848.3.d0135.60.19gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYKPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISESQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GDRIR
VLDX

>HV1300825_CH848.3.d0135.60.20gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEKQWNKTLQEVGKELQKHFPNKTIKYERSAGGDMEIATHSFNCG
GEFFYCNTSNLFNGTYNGTYISTNSNSNITLQCRIKQIINMWQGVGRAMYAPPIAGNITCKSNITGLLLTRDGGTKN
NSNETEEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GHRIR
VPDXX

>HV1300826_CH848.3.d0135.60.32gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEGQWNKTLQEVGKELQKHFPNKTIKYERSAGGDMEIATHSFNCG
GEFFYCNTSNLFNGTYNGTYISTNSTSNITLQCRIKQIINMWQGVGRAMYAPPIAGNITCKSNITGLLLTRDGGTKN
NSNETEEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYQTETIYMLLEDSQHQQERNEKDLLALDSWNSLWNWFNITNWLWYIR**GHRIQ
DPDX

>HV1300827_CH848.3.d0135.60.34gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSNSNITLQCRIKQIINMWQGVGRAMYAPPIAGNITCKSNITGLLLTRDGGTKN
NSNETEEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYMLLEDSQHQQERNEKDLLALDSWNSLWNWFNITNWLWYIR**GHRIQ
VPDX

>HV1300828_CH848.3.d0194.25.17gp140C

MRVMGILKNYPQWWIWGILGFWMLMICNGKGNLWVTVYYGVPVWKEAKTTLFCASDAKAYEKEVHNVWATHACVPTD
PSPQELVLENVIENFNMWKNDMVDQMHEDIISLWDQSLKPCVKLTPLCVTLNCSNATVDSSKVYDTRSNVNVTSINN

Figure 8 continued

TIMGEMKNCSFNTTTEIRDKEKKEYALFYRSDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSSTNSTSNITLQCRIKQIINMWQGVGRAMYAPPIAGNITCKSNITGLLLTRDG
GTKNNSNETEETFRPAGGDMRDNWRSELYKYKVVEIQPLGIAPTGAKERVVEREKEAAGLGALFLGFLGAAGSTMGA
ASITLTVQARQLLSGIVQQQSNLLRAIEAQQHMLQLTVWGIKQLQARVLALERYLKDQQLLGMWGCSGKLICTTAVP
WNASWSNKSEKDIWDNMTWMQWEREISNYTETIYMLLEDSQHQQERNEKDLLALDSWNSLWNWFNITNWLWYIR**G
HRIRDLDX

>HV1300829_CH848.3.d0194.25.21gp140C

MKVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEKQWNKTLQEVGKELQKHFPNKTIKYERSAGGDMEIATHSFNCG
GEFFYCNTSNLFNGTYNGTYISTNSTSSITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTDVPWNTS
WSNKSEKDIWDNMTWMQWEREISNYTETIYMLLEDSQHQQERNEKDLLALDSWNSLWNWFNITNWLWYIR**GHRIR
VLDX

>HV1300830_CH848.3.d0194.25.24gp140C

MRVMGILKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNATVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISESQWNKTLQEVGKELQKHFPNKTIKYERSAGGDMEIATHSFNCG
GEFFYCNTSNLFNGTYNGTYINTSSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNNS
WSNKSEKDIWDNMTWMQWEREISNYTETIYMLLEDSQHQQERNEKDLLALDSWNSLWNWFNITNWLWYIK**GNRIR
VPDXX

>HV1300831_CH848.3.d0194.25.48gp140C

MPVMGIPKNYPQWWIWGILGFWMLMICNGKGNLWVTVYYGVPVWKEAKTTLFCASDAKAYEKEVHNVWATHACVPTD
PSPQELVLENVTENFNMWKNDMVDQMHEDIISLWDQSLKPCVKLTPLCVTLNCSNAIVDSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEWQWNKTLQEVGKELQKHFPNKTIKYERSAGGDMEIATHSFNCG
GEFFYCNTSNLFNGTYNGTYINTSSTSNITLQCRIKQIINMWQGVGRAMYAPPIAGNITCKSNITGLLLTRDGGTKN
NSNETEETFRPAGGDMRDNWRSELYKYKVVEIQPLGIAPTGARERVVEREKEAAGLGALFLGFLGAAGSTMGAASIT
LTVQARQLLSGIVQQQSNLLRAIEAQQHMLQLTIWGIKQLQARVLALERYLKDQQLLGMWGCSGKLICTTAVPWNTS
WSNKSEKDIWDNMTWMQWEREISNYTETIYTLLEDSQHQQERNEKDLLALDSWNSLWNWFNITNWLWYIR**GNRIQ
DPDX

>HV1300832_CH848.3.d0274.30.02gp140C

MRVMGILKNYPQWWIWGILGFWMLMICNGKGKLWVTVYYGVPVWKEAKTTLFCASDAKAYEKEVHNVWATHACVPTD
PSPQELVLKNVTENFNMWKNDMVDQMHEDIISLWDQSLKPCVKLTPLCVTLNCSNATVNSSKVYDTRSNVNVTSINN
TIMGEMKNCSFNTTTEIRDKEKKEYALFYRPDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEWQWNKTLHEVGKELQKHFPNKTIKYERSAGGDMEIATHSFNCG
GEFFYCNTSNLFNGTYNGTYINTSSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNSS

Figure 8 continued

WSNKSEKDIWDNMTWMQWEREISNYTETIYKLLEDSQHQQERNEQDLLALDSWNSLWNWFNITNWLWYIK**GNRIQ
VPDX

>HV1300833_CH848.3.d0274.30.07gp140C

MRVMGIPKNYPQWWIWGILGFWILMICNGKGKLWVTVYYGVPVWKEAKTTLFCASDAKAYEKEVHNVWATHACVPTD
PSPQELVLKNVTENFNMWKNDMVDQMHEDIISLWDQSLKPCVKLTPLCVTLNCNSATVDNSKVYDTRSNVNVTSINN
TIMGEMKNCSFNTTTEIPDKEKKEYALFYKPDVVPLDETSNTSEYRLINCNTSAVTQACPKVTFEPIPIHYCAPAGY
AILKCNDKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEGQWNKTLHEVSKELQKHFPNKTIKYERSAGGDMEIATHSFNCG
GEFFYCNTSNLFNGTYNGTYINTSSTSNITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYTLLEDSQHQQERNEKDLLALDSWNSLWNWFNITNWLWYIK**GNRIR
DLDX

>HV1300834_CH848.3.d0274.30.09gp140C

MRVRGILKNYPQWWIWGILGFWMLMICNGKGKLWVTVYYGVPVWKEAKTTLFCASDAKAYEKEVHNVWATHACVPTD
PSPQELVLENVIENFNMWKNDMVDQMHEDIISLWDQSLKPCVKLTPLCVTLNCSNATVNSSKVYDTRSNVNVTSINN
TIMGEMKNCSFNTTTEIRDKEKKEYALFYRSDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTPVEIVCTRPG
NNTRKSVRIGPGQTFYATGDIIGDIRQAHCNISERQWNKTLQEVGKELQKHFPNKTIKYERSAGGDMEIATHSFNCG
GEFFYCNTSNLFNGTYNGTYISTNSSTNSTSNITLQCRIKQIINMWQGVGRAMYAPPIAGNITCKSNITGLLLTRDG
GTKNNSNETEETFRPAGGDMRDNWRSELYKYKVVEIQPLGIAPTGAKERVVEREKEAAGLGALFLGFLGAAGSTMGA
ASITLTVQARQLLSGIVQQQSNLLRAIEAQQHMLQLTVWGIKQLQARVLALERYLKDQQLLGMWGCSGKLICTTTVP
WNASWSNKSEKDIWDNMTWMQWEREISNYTETIYMLLEDSQRQQERNEKDLLALDSWNSLWNWFNITNWLWYIR**G
NRIRVLDX

>HV1300835_CH848.3.d0274.30.14gp140C

MRVMGILKNYLQWWIWGILGFWMLMICKGKGNLWVTVYYGVPVWKEAKTTLFCASDAKAYEKEVHNVWATHACVPTD
PSPQELVLENVIENFNMWKNDMVDQMHEDIISLWDQSLKPCVKLTPLCVTLTCSNATVDNSKVYDTRSNVNVTSINN
TIMGEMKNCSFNTTTEIRDKEKKEYALFYRSDVVPLDETSNTSEYRLINCNTSAVTQACPKVTFEPIPIHYCAPAGY
AILKCNNKTFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISERQWYKTLQEVGKELQKHFPNKTIKYERSAGGDMEIATHSFNCG
GEFFYCNTSNLFNGTYNGTYISINSTSYITLQCRIKQIINMWQGVGRAMYAPPIAGNITCKSNITGLLLTRDGGTKN
NSNETEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTAVPWNTS
WSNKSEKDIWDNMTWMQWEREISNYTETIYTLLEDSQHQQERNEKDLLALDSWNSLWNWFNITNWLWYIK**GYRIR
VPDXX

>HV1300836_CH848.3.d0358.80.03gp140C

MKVMGILKNYPQWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLNCSNARSNVNVTSINNTIMGEMKNCS
FNTTTEIRDKEKKEYALFYKPDVVPLNETSNTSEYRLINCNTSAVTQACPKVTFEPIPIHYCAPAGYAILKCNNETF
NGTGPCSNVSTVQCTHGIRPVVSTQLLLNGSLAEKEIVIRSENLTNNAKIIIVHLNTPVEIVCTRPGNNTRKSVRIG
PGQTFYATGDIIGDIRQAHCNISEGQWNKTLQEVGKELQKHFPNKTIKYERSAGGDMEITTHSFNCGGEFFYCNTSN
LFNGTYNGTYINISTNSNSTITLQCRIKQIINMWQGVGRAMYAPPIAGNITCKSNITGLLLTRDGGTKNNSNEETFR
PAGGDMRDNWRSELYKYKVVEIQPLGIAPTGAKERVVEREKEAAGLGALFLGFLGAAGSTMGAASITLTVQARQLLS
GIVQQQSNLLRAIEAQQHMLQLTVWGIKQLQARVLALERYLKDQQLLGMWGCSGKLICTTAVAWNTSWSNKSEKDIW
DNMTWMQWEREISNYTETIYTLLEDSQRQQERNEKDLLALDSWNSLWNWFNITNWLWYIK**GYRIQDPDX

>HV1300837_CH848.3.d0358.80.06gp140C

MRVMGIPKNYPQWWIWGILGFWMLMICNGKGKLWVTVYYGVPVWKEAKTTLFCASDAKAYEKEVHNVWATHACVPTD
PSPQELVLKNVTENFNMWKNDMVDQMHEDIISLWDQSLKPCVKLTPLCVTLNCSNARSNVNVTSINNTIMGEMKNCS
FNTTTEIRDKEKKEYALFYKPDVVPLNETSNTSEYRLINCNTSAVTQACPKVTFEPIPIHYCAPAGYAILKCNNKTF

Figure 8 continued

NGTGPCSNVSTVQCTHGIRPVVSTQLLLNGSLAEKEIVIRSENLTNNAKIIIVHLNTSVEIVCTRPGNNTRKSVRIG
PGQTFYATGDIIGDIRQAHCNISEGQWNKTLHEVSKELQKHFPNKTIKYERSAGGDMEIATHSFNCGGEFFYCNTSN
LFNGTYNGTYINTSSTSYITLQCRIKQIINMWQGVGRAMYAPPIAGNITCKSNITGLLLTRDGGTKNNSNEETFRPA
GGDMRDNWRSELYKYKVVEIQPLGIAPTGAKERVVEREKEAAGLGALFLGFLGAAGSTMGAASITLTVQARQLLSGI
VQQQSNLLRAIEAQQHMLQLTVWGIKQLQARVLALERYLKDQQLLGMWGCSGKLICTTTVPWNTSWSNKSEKDIWDN
MTWMQWEREISNYTETIYTLLEDSQRQQERNEKDLLALDSWNSLWNWFNITNWLWYIK**GYRIQVPDX

>HV1300838_CH848.3.d0358.80.17gp140C

MRVMGILKNYPQWWIWGILGFWMLMNCNGKGNLWVTVYYGVPVWKEAKTTLFCASDAKAYKKEVHNVWATHACVPTD
PSPQELVLENVTENFNMWKNDMVDQMHEDIISLWDQSLKPCVKLTPLCVTLNCSNARSNVNVTSINNTIMGEMKNCS
FNTTTEIRDKEKKEYALFYRPDVVPLNETSNTSEYRLINCNTSAVTQACPKVTFEPIPIHYCAPAGYAILKCNNETF
NGTGPCSNVSTVQCTHGIRPVVSTQLLLNGSLAEKEIVIRSENLTNNAKIIIVHLNTSVEIVCTRPGNNTRKSVRIG
PGQTFYATGDIIGDIRQAHCNISEEKWNKTLQQVGKELQKHFPNKTIKYERSAGGDMEITTHSFNCGGEFFYCNTSN
LFNGTYNGTYINISTNSNSTITLQCRIKQIINMWQGVGRAMYAPPIAGNITCKSNITGLLLTRDGGTKNNSNEETFR
PAGGDMRDNWRSELYKYKVVEIQPLGIAPTGAKERVVEREKEAAGLGALFLGFLGAAGSTMGAASITLTVQARQLLS
GIVQQQSNLLRAIEAQQHMLQLTVWGIKQLQARVLALERYLKDQQLLGMWGCSGKLICTTAVAWNTSWSNKSEKDIW
DNMTWMQWEREISNYTETIYTLLEDSQRQQERNEKDLLALDSWNSLWNWFNITNWLWYIK**GYRIPDLDX

>HV1300839_CH848.3.d0358.80.44gp140C

MRVMGILKNYPRWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLNCSNARSNVNVTSINNTIMGEMKNCS
FNTTTEIRDKEKKEYALFYKPDVVPLNETSNTSEYRLINCNTSAVTQACPKVTFEPIPIHYCAPAGYAILKCNNKTF
NGTGPCSNVSTVQCTHGIRPVVSTQLLLNGSLAEKEIVIRSENLTNNAKIIIVHLNTSVEIVCTRPGNNTRKSVRIG
PGQTFYATGDIIGDIRQAHCNISEEKWNKTLQEVGKELQKHFPNKTIKYERSAGGDMEIATHSFNCGGEFFYCNTSN
LFNGTYNGTDISTNSNSTITLQCRIKQIINMWQGVGRAMYAPPIAGNITCKSNITGLLLTRDGGTKNNSNEETFRPA
GGDMRDNWRSELYKYKVVEIQPLGIAPTGAKERVVEREKEAAGLGALFLGFLGAAGSTMGAASITLTVQARQLLSGI
VQQQSNLLRAIEAQQHMLQLTVWGIKQLQARVLALERYLKDQQLLGMWGCSGKLICTTTVPWNASWSNKSEKDIWDN
MTWMQWEREISNYTETIYMLLEDSQRQQERNEKDLLALDSWNSLWNWFNITNWLWYIK**GYRIRVLDX

>HV1300840_CH848.3.d0445.25.04gp140C

MRVMGIPKNYPQWWIWGILGFWMLMNCNGKGNLWVTVYYGVPVWKEAKTTLFCASDAKAYKKEVHNVWATHACVPTD
PSPQELVLDNVTENFNMWKNDMVDQMHEDIISLWDQSLKPCVKLTPLCVTLNCSNVNVVNVTNITNTIKGEMKNCSF
NTTTEIRDKEKKEYALFYRPDVVPLNETSNTSEYRLINCNTSAVTQACPKVTFEPIPIHYCAPAGYAILKCNNETFN
GTGPCSNVSTVQCTHGIRPVVSTQLLLNGSLAEKGIVIRSENLTNNAKIIIVQLNTSVEIVCTRPGNNTRKSVRIGP
GQTFYATGDIIGDIRQAHCNISEEKWNKTLHEVSKELQKHFPNKTIKYERSAGGDMEIATHSFNCGGEFFYCNTSKL
FNGTYNGTYISTNSTSYITLQCRIKQIINMWQGVGRAMYAPPIAGNITCKSNITGLLLTRDGGTNNNSNEETFRPAG
GDMRDNWRSELYKYKVVEIQPLGIAPTGAKERVVEREKEAAGLGALFLGFLGAAGSTMGAASITLTVQARQLLSGIV
QQQSNLLRAIEAQQHMLQLTVWGIKQLQARVLALERYLKDQQLLGMWGCSGKLICTTAVAWNTSWSNKSEKDIWDNM
TWMQWEREISNYTETIYTLLEDSQRQQERNEKDLLALDSWNSLWNWFNITNWLWYIK**GTRIR*PDX

>HV1300841_CH848.3.d0445.25.18gp140C

MRVMGIPKNYPQWWIWGILGFWMLMNCNGKENLWVTVYYGVPVWKEAKTTLFCASDAKAYKKEVHNVWATHACVPTD
PSPQELVLKNVTENFNMWKNDMVDQMHEDIISLWDQSLKPCVKLTPLCVTLNCSNVNVVNVTNITNTIKGEMKNCSF
NTTTEIRDKEKKEYALFYRPDVVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLHTPVEIVCTRPGNNTRKSVRIGP
GQTFYATGDIIGDIRQAHCNISEEKWNKTLQEVGKELQKHFPNKTIKYERSAGGDMEITTHSFNCGGEFFYCNTSNL
FNGTYNGPYINISTNSNSTITLQCRIKQIINMWQGVGRAMYAPPIAGNITCKSNITGLLLTRDGGTKNNSNEETFRP
AGGDMRDNWRSELYKYKVVEIQPLGIAPTGAKERVVEREKEAAGLGALFLGFLGAAGSTMGAASITLTVQARQLLSG
IVQQQSNLLRAIEAQQHMLQLTVWGIKQLQARVLALERYLKDQQLLGMWGCSGKLICTTAVAWNTSWSNKSEKDIWD
NMTWMQWEREISNYTETIYTLLEDSQRQQERNEKDLLALDSWNSLWNWFNITNWLWYIK**GTRIRSPDXX

>HV1300842_CH848.3.d0445.25.26gp140C

MRVMGILKNYPQWWIWGILGFWMLMICNGKGKLWVTVYYGVPVWKEAKTTLFCASDAKAYEKEVHNVWATHACVPTD
PSPQELVLKNVTENFNMWKNDMVDQMHEDIISLWDQSLKPCVKLTPLCVTLDCSNVNVVNVTNITNTIKGEMKNCSF

Figure 8 continued

NTTTEIRDKEKKEYALFYRPDVVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTPVEIVCTRPGNNTRKSVRIGP
GQTFYATGDIIGDIRQAHCNISEKQWNETLQKVGKELQKHFPNKTIKYERSAGGDMEITTHSFNCGGEFFYCNTSNL
FNGTYNGTYINISTNSNSTITLQCRIKQIINMWQGVGRAMYAPPIAGNITCRSNITGLLLTRDGGTKNNSNEETFRP
AGGDMRDNWRSELYKYKVVEIQPLGIAPTGAKERVVEREKEAAGLGALFLGFLGAAGSTMGAASITLTVQARQLLSG
IVQQQSNLLRAIEAQQHMLQLTVWGIKQLQARVLALERYLKDQQLLGMWGCSGKLICTTAVPWNSSWSNKSEKDIWD
NMTWMQWEREISNYTETIYTLLEDSQRQQEPNEKDLLALDSWNSLWNWFNITKWLWYIK**GTRIR*PDXX

>HV1300843_CH848.3.d0445.30.41gp140C

MRVMGILKNYPQWWIWGILGFWMLMICKGKGNLWVTVYYGVPVWKEAKTTLFCASDAKAYEKEMHNVWATHACVPTD
PSPQELFLENVTENFNMWKNDMVDQMHEDIISLWDQSLKPCVKLTPLCVTLNCSNVSNVNVTNITNTIKGEMKNCSF
NTTTEIRDKEKKEYALFYRPDVVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEEKWNKTLQQVGKELQKHFPNKTIKYERSAGGDMEIATHSFNCGGEFFYCNTSNL
FNGTYNGTYSTNSTSTITLQCRIKQIINMWQGVGPRAMYAPPIAGNITCKSNITGLLLTRDGGTKNNSNEETFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICNTAVAWNTSWSNKSEKDIWDNMT
WMQWEREISNYTETIYTLLEDSQRQQERNEKDLLALDSWNSLWNWFNITNWLWYIK**GTRIRLPDX

>HV1300844_CH848.3.d0445.30.42gp140C

MRVMGILKNYPPWWIWGILGFWMLMICNGKGKLWVTVYYGVPVWKEAKTTLFCASDAPAYEKEVHNVWATHACVPTD
PSPQELVLGNVTENFNMWKNDMVDQMHEDIISLWDQSLKPCVKLTPLCVTLNCSNVNVVNVTNITNTIKGEMKNCSF
NTTTEIRDKEKKEYALFYKPDVVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLNTSVEIVCTRPGNNTRKSVRIGP
GQTFYATGDIIGDIRQAHCNISEEKWNKTLHEVSKELQKHFPNKTIKYERSAGGDMEIATHSFNCGGEFFYCNTSNL
FNGTYNGTYISTNSSANSNSTITLQCRIKQIINMWQGVGRAMYAPPIAGNITCKSNITGLLLTRDGGTKNNSNEETF
RPAGGDMRDNWRSELYKYKVVEIQPLGIAPTGAKERVVEREKEAAGLGALFLGFLGAAGSTMGAASITLTVQARQLL
SGIVQQQSNLLRAIEAQQHMLQLTVWGIKQLQARVLALERYLKDQQLLGMWGCSGKLICTTAVAWNTSWSNKSEKDI
WDNMTWMQWEREISNYTETIYTLLEDSQRQQERNEKDLLALDSWNSLWNWFNITNWLWYIK**GSRIR*PDX

>HV1300845_CH848.3.d0526.25.02gp140C

MKVMGILKNYPQWWIWGILGFWMLMICKGKGNLWVTVYYGVPVWKEAKTTLFCASDARAYEKEVHNVWATHACVPTD
PSPQELFLENVTENFNMWKNDMVDQMHEDIISLWDQSLKPCVKLTPLCVTLICSNATVNNRTAYDTRSNVNVTSINN
TIMGEMKNCSFNTTTEIRDKEKKEYALFYKPDIVPLNETSNTSEYRLINCNTSAVTQACPKVTFEPIPIHYCAPAGY
AILKCNNETFNGTGPCSNVSTVQCTHGIRPVVSTQLLLNGSLAEKEIVIRSENLTNNAKIIIVHLNTSVEIVCTRPG
NNTRKSVRIGPGQTFYATGDIIGDIRQAHCNISEKQWNETLQKVGKELQKHFPNKTIKYERSAGGDMEIATHSFNCG
GEFFYCNTSKLFNGTYNGTDINISTNSNSTITLQCRIKQIINMWQGVGRAMYAPPIAGNITCKSNITGLLLTRDGGT
NSNKTEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTNVPWNTS
WSNKSEKDIWDNMTWMQWEREISNYTETIYMLLEDSQRQQERNEKDLLALDSWNSLWNWFNITNWLWYIK**EDPNS
VTGS

>HV1300846_CH848.3.d0526.25.09gp140C

MRVMGILKNYPQWWIWGILGFWMLMICNGKGKLWVTVYYGVPVWKEAKTTLFCASDAPAYEKEVHNVWATHACVPTD
PSPQELFLENVTENFNMWKNDMVDQMHEDIISLWDQSLKPCVKLTPLCVTLNCSNVNVTGSNVNVTNITNTITGEMK
NCSFNTTTEIRDKEKKEYALFYKPDVVPLNETSNTSEYRLINCNTSAVTQACPKVTFEPIPIHYCAPAGYAILKCNN
ETFNGTGPCSNVSTVQCTHGIRPVVSTQLLLNGSLAEKGIVIRSENLTNNAKIIIVQLNTSVEIVCTRPGNNTRKSV
RIGPGQTFYATGGIIGDIRQAHCNISESKWNETLHEVSKELQKHFPNKTIKYERSAGGDMEITTHSFNCGGEFFYCN
TSNLFNGTYNGTYNGTNSNSTITLQCRIKQIINMWQGVGRAMYAPPIAGNITCRSNITGLLLTRDGGTNSNKTEETF
RPAGGDMRDNWRSELYKYKVVEIQPLGIAPTGAKERVVEREKEAAGLGALFLGFLGAAGSTMGAASITLTVQARQLL
SGIVQQQSNLLRAIEAQQHMLQLTVWGIKQLQARVLALERYLKDQQLLGMWGCSGKLICTTNVPWNTSWSNKSEKDI
WDNMTWMQWEREISNYTETIYTLLEDSQRQQERNEKDLLALDSWNSLWNWFNITNWLWYIK**EVPNSVTGS

MRVMGIPKNYPQWWIWGILGFWMLMNCNGKGNLWVTVYYGVPVWKEAKTTLFCASDAKAYKKEVHNVWATHACVPTD
PSPQELVLKNVTENFNMWKNDMVDQMHEDIISLWDQSLKPCVKLTPLCVTLNCSNVNVVNVTNITNTIKGEMKNCSF
NTTTEIRDKEKKEYALFYRPDVVPLNETSNTSEYRLINCNTSAVTQACPKVTFEPIPIHYCAPAGYAILKCNNETFN
GTGPCSNVSTVQCTHGIRPVVSTQLLLNGSLAEKEIVIRSENLTNNAKIIIVHLHTPVEIVCTRPGNNTRKSVRIGP
GQTFYATGDIIGDIRQAHCNISEEKWNKTLQQVGKELQKHFPNKTIKYERSAGGDMEITTHSFNCGGEFFYCNTSNL
FNGTYNGKYINISTNSNSTITLQCRIKQIINMWQGVGRAMYAPPIAGNITCKSNITGLLLTRDGGTKNNSTETEETF
RPAGGDMRDNWRSELYKYKVVEIQPLGIAPTGAKERVVEREKEAAGLGALFLGFLGAAGSTMGAASITLTVQARQLL
SGIVQQQSNLLRAIEAQQHMLQLTVWGIKQLQARVLALERYLKDQQLLGMWGCSGKLICTTDVPWNTSWSNKSEKDI
WDNMTWMQWEREISNYTETIYTLLEDSQRQQERNEKDLLALDSWNSLWNWFNITNWLWYIK**GT*IR*PDX

>HV1300848_CH848.3.d0526.25.11gp140C

MRVMGILKNCPQWWIWGILGFWMLMICNGKENLWVTVYYGVPVWKEAKTTLFCASDAKAYKKEVHNVWATHACVPTD
PSPQELVLKNVTENFNMWKNDMVDQMHEDIISLWDQSLKPCVKLTPLCVTLICSNATVNNRTVYDTRSNVSVTSINN
TIMGEMKNCSFNTTTEIRDKEKKEYALFYRPDIVPLNETSNTSEYRLINCNTSAVTQACPKVTFEPIPIHYCAPAGY
AILKCNNETFNGTGPCSNVSTVQCTHGIRPVVSTQLLLNGSLAEKEIVIRSENLTNNAKIIIVHLNTPVEIVCTRPS
NNTRKSVRIGPGQTFYATGDIIGDIRQAHCNISEEKWNKTLQKVGKELQKHFPNKTIKYERSAGGDMEITTHSFNCG
GEFFYCNTSNLFNGTYNGTYTNISTNSNSTITLQCRIKQIINMWQGVGRAMYAPPIAGNITCRSNITGLLLTRDGGT
NSNKTEETFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTNVPWNTS
WSNKSEKDIWDNMTWMQWEREISNYTETIYTLLEDSQRQQERNEKDLLALDSWNSLWNWFNITNWLWYIK**GS*IR
*PDX

>HV1300849_CH848.3.d0526.25.21gp140C

MRVMGIPKNYPQWWIWGILGFWMLMNCNGKENLWVTVYYGVPVWKEAKTTLFCASDAKAYKKEVHNVWATHACVPTD
PSPQELVLKNVTENFNMWKNDMVDQMHEDIISLWDQSLKPCVKLTPLCVTLNCVNVTNITNTIKGEMKNCSFNTTTE
IRDKEKKEYALFYRPDVVPLNETSNTSEYRLINCNTSAVTQACPKVTFEPIPIHYCAPAGYAILKCNNETFNGTGPC
SNVSTVQCTHGIRPVVSTQLLLNGSLAEKGIVIRSENLTNNAKIIIVQLNTSVEIVCTRPGNNTRKSVRIGPGQTFY
ATGDIIGDIRQAHCNISEEKWNKTLQQVGKELQKHFPNKTIKYERSAGGDMEITTHSFNCGGEFFYCNTSNLFNGTY
NGTYNGSTNSNSTITLQCRIKQIINMWQGVGRAMYAPPIAGNITCRSNITGLLLTRDGGTNSNKTEETFRPAGGDMR
DNWRSELYKYKVVEIQPLGIAPTGAKERVVEREKEAAGLGALFLGFLGAAGSTMGAASITLTVQARQLLSGIVQQQS
NLLRAIEAQQHMLQLTVWGIKQLQARVLALERYLKDQQLLGMWGCSGKLICTTNVPWNTSWSNKSEKDIWDNMTWMQ
WEREISNYTETIYTLLEDSQRQQERNEKDLLALDSWNSLWNWFNITNWLWYIK**GSPIRSPDX

>HV1300850_CH848.3.d0526.25.32gp140C

MRVMGIPKNYPQWWIWGILGFWMLMNCNGKENLWVTVYYGVPVWKEAKTTLFCASDARAYEKEVHNVWATHACVPTD
PSPQELFLENVTENFNMWKNDMVDQMHEDIISLWDQSLKPCVKLTPLCVTLICSNATVNNRTVYDTRSNANVTSINN
TIMGEMKNCSFNTTTEIRDKEKKEYALFYRPDIVPLNETSNTSEYRLINCNTSAVTQACPKVTFEPIPIHYCAPAGY
AILKCNNETFNGTGPCSNVSTVQCTHGIRPVVSTQLLLNGSLAEKEIVIRSENLTNNAKIIIVHLHTPVEIVCTRPG
NNTRKSVRIGPGQTFYATGDIIGDIRQAHCNISEEKWNKTLQKVGKELQKHFPNKTIKYERSAGGDMEITTHSFNCG
GEFFYCNTSNLFNGTYNGTYNGTNSNSTITLQCRIKQIINMWQGVGRAMYAPPIAGNITCRSNITGLLLTRDGGTNS
NKTEETFRPAGGDMRDNWRSELYKYKVVEIQPLGIAPTGAKERVVEREKEAAGLGALFLGFLGAAGSTMGAASITLT
VQARQLLSGIVQQQSNLLRAIEAQQHMLQLTVWGIKQLQARVLALERYLKDQQLLGMWGCSGKLICTTTVAWNTSWS
NKSEKDIWDNMTWMQWEREISNYTETIYTLLEDSQRQQERNEKDLLALDSWNSLWNWFNITNWLWYIK**EDPNSVT
GS

>HV1300851_CH848.3.d0526.25.39gp140C

MRVMGIPKNYPQWWIWGILGFWMLMICSGRGNLWVTVYYGVPVWKEAKTTLFCASDAKAYEKEMHNVWATHACVPTD
PSPQELFLENVTENFNMWKNDMVDQMHEDIISLWDQSLKPCVKLTPLCVTLICSNATVNNRTVYDTRSNVNVTSINN
TIMGEMKNCSFNTTTEIRDKEKKEYALFYKPDIVPLNETSNTSEYRLINCNTSAVTQACPKVTFEPIPIHYCAPAGY
AILKCNNETFNGTGPCSNVSTVQCTHGIRPVVSTQLLLNGSLAEKEIVIRSENLTNNAKIIIVHLNTPVEIVCTRPG
NNTRKSVRIGPGQTFYATGDIIGDIRQAHCNISEEKWNKTLQKVGKELQKHFPNKTIKYERSAGGDMEITTHSFNCG
GEFFYCNTSKLFNGTYNGINISTNSNSTITLQCRIKQIINMWQGVGRAMYAPPIAGNITCKSNITGLLLTRDGGNRN
NSNEETFRPAGGDMRDNWRSELYKYKVVEIQPLGIAPTGAKERVVEREKEAAGLGALFLGFLGAAGSTMGAASITLT
VQARQLLSGIVQQQSNLLRAIEAQQHMLQLTVWGIKQLQARVLALERYLKDQQLLGMWGCSGKLICTTNVPWNTSWS

Figure 8 continued

NKSEKDIWDNMTWMQWEREISNYTETIYMLLEDSQRQQERNEKDLLALDSWNSLWNWFNITNWLWYIK**EVPNSVT
GS

>HV1300852_CH848.3.d0611.9.02gp140C

MRVMGIPKNYPQWWIWGILGFWMLMNCNGKENLWVTVYYGVPVWKEAKTTLFCASDAKAYKKEVHNVWATHACVPTD
PSPQELVLKNVTENFNMWKNDMVDQMHEDIISLWDQSLKPCVKLTPLCVTLICSNATVNNRTVYEMKNCSFNTTTEI
RDKEKKEYALFYRPDIVPLGETSNTSEYRLINCNTSAVTQACPKVTFEPIPIHYCAPAGYAILKCNNETFNGTGPCS
NVSTVQCTHGIRPVVSTQLLLNGSLAEKGIVIRSENLTNNAKIIIVHLHTPVEIVCTRPGNNTRKSVRIGPGQTFYA
TGDIIGDIRQAHCNISEEKWNETLQKVGKELQKHFPNKTIKYAQSAGGDMEITTHSFNCGGEFFYCNTSKLFNGTYN
GAYINISTNSNSTITLQCRIKQIINMWQGVGRAMYAPPIAGNITCKSNITGLLLTRDGGTNNKTEEIFRPAGGDMRD
NWRSELYKYKVVEIQPLGIAPTGAKERVVEREKEAAGLGALFLGFLGAAGSTMGAASITLTVQARQLLSGIVQQQSN
LLRAIEAQQHMLQLTVWGIKQLQARVLALERYLKDQQLLGMWGCSGKLICTTVVPWNTSWSNKSEKDIWDNMTWMQW
EREISNYTETIYKLLEDSQNQQERNEQDLLALDSWNSLWNWFNITKWLWYIK**GT*IRSPDX

>HV1300853_CH848.3.d0611.20.12gp140C

MRVMGIPKNYPQWWIWGILGFWMLMNCNGKGNLWVTVYYGVPVWKEAKTTLFCASDAKAYKKEVHNVWATHACVPTD
PSPQELFLENVTENFNMWKNDMVDQMHEDIISLWDQSLKPCVKLTPLCVTLICSNATVNNRTMGEMKNCSFNTTTEI
RDKEKKEYALFYKPDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPGNNTRKSVRIGPGQTFYA
TGAIIGDIRQAHCNISESKWNETLQKVGKELQKHFPNKTIKYEQSAGGDMEITTHSFNCGGEFFYCNTSKLFNGTYN
GAYINISTNSNSTITLQCRIKQIINMWQGVGRAMYAPPIAGNITCKSNITGLLLTRDGGTNNKTEEIFRPAGGDMRD
NWRSELYKYKVVEIQPLGIAPTGAKERVVEREKEAAGLGALFLGFLGAAGSTMGAASITLTVQARQLLSGIVQQQSN
LLRAIEAQQHMLQLTVWGIKQLQARVLALERYLKDQQLLGMWGCSGKLICTTNVPWNTSWSNKSEKDIWDNMTWMQW
EREISNYTETIYMLLEDSQRQQERNEKDLLALDSWNSLWNWFNITNWLWYIK**GS*IRSPDX

>HV1300854_CH848.3.d0611.20.14gp140C

MKVMGIPKNYPQWWIWGILGFWMLMNCNGKENLWVTVYYGVPVWKEAKTTLFCASDAKAYKKEVHNVWATHACVPTD
PSPQELVLGNVTENFNMWKNDMVDQMHEDIISLWDQSLKPCVKLTPLCVTLICSNATVNNRTVYEMKNCSFNTTTEI
RDKEKKEYALFYRPDIVPLNETSNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHTPVEIVCTRPGNNTRKSVRIGPGQTFYA
TGDIIGDIRQAHCNISEKQWNETLQKVGKELQKHFPNKTIKYERSAGGDMEITTHSFNCGGEFFYCNTSKLFNGTYN
GTDISTNSSANSNSTITLQCRIKQIINMWQGVGRAMYAPPIAGNITCKSNITGLLLTRDGGTNSSEEIFRPAGGDMR
DNWRSELYKYKVVEIQPLGIAPTGAKERVVEREKEAAGLGALFLGFLGAAGSTMGAASITLTVQARQLLSGIVQQQS
NLLRAIEAQQHMLQLTVWGIKQLQARVLALERYLKDQQLLGMWGCSGKLICTTAVAWNTSWSNKSEKDIWDNMTWMQ
WEREISNYTETIYKLLEDSQNQQERNEQDLLALDSWNSLWNWFNITKWLWYIK**GSRIR*PDXX

>HV1300855_CH848.3.d0611.20.28gp140C

MRVMGILKNCPQWWIWGILGFWMLMICNGKGKLWVTVYYGVPVWKEAKTTLFCASDARAYEKEVHNVWATHACVPTD
PSPQELVLDNVTENFNMWKNDMVDQMHEDIISLWDQSLKPCVKLTPLCVTLICSNATVNNRTVYEMKNCSFNTTTEI
RDKEKKEYALFYRPDIVPLNETSNTSEYRLINCNTSAVTQACPKVTFEPIPIHYCAPAGYAILKCNNKTFNGTGPCS
KVSTVQCTHGIRPVVSTQLLLNGSLAEKEIVIRSENLTNNAKIIIVHLHTPVEIVCTRPGNNTRKSVRIGPGQTFYA
TGDIIGDIRQAHCNISEEKWNETLQKVGKELQKHFPNKTIKYAQSAGGDMEITTHSFNCGGEFFYCNTSKLFNGTYN
GAYINISTNSNSTITLQCRIKQIINMWQGVGRAMYAPPIAGNITCKSNITGLLLTRDGGTNNKTEEIFRPAGGDMRD
NWRSELYKYKVVEIQPLGIAPTGAKERVVEREKEAAGLGALFLGFLGAAGSTMGAASITLTVQARQLLSGIVQQQSN
LLRAIEAQQHMLQLTVWGIKQLQARVLALERYLKDQQLLGMWGCSGKLICTTNVPWNTSWSNKSEKDIWDNMTWMQW
EREISNYTETIYMLLEDSQRQQERNEKDLLALDSWNSLWNWFNITNWLWYIK**EDPNSVTGS

>HV1300856_CH848.3.d0700.15.06gp140C

MRVMGIPKNYPQWWIWGILGFWMLMNCNGKENLWVTVYYGVPVWKEAKTTLFCASDAKAYKKEVHNVWATHACVPTD
PSPQELVLKNVTENFNMWKNNPVDQMHEDIISLWDQSLKPCVKLTPLCVTLICSNATVDNRTVGEMKNCSFNTTTEI
RDKEKKEYALFYKPDVVPLDETNNTSEYRLINCNTSAVTQACPKVTFEPIPIHYCAPAGYAILKCNNETFNRTGPCS
NVSTVQCTHGIRPVVSTQLLLNGSLAEKEIVIRSENLTNNAKIIIVHLNTPVEIVCTRPGNNTRKSVRIGPGQTFYA
TGGIIGDIRQAHCNISEGQWNETLQKVGKELQKHFPNKTIKYEQSAGGDMEITTHSFNCGGEFFYCNTSKLFNGTYN
GTYISTNSSTNSTSTITLQCRIKQIINMWQGVGRAMYAPPIAGNITCKSNITGLLLTRDGGTNSSEEIFRPAGGDMR

Figure 8 continued

```
DNWRSELYKYKVVEIQPLGIAPTGAKERVVEREKEAAGLGALFLGFLGAAGSTMGAASITLTVQARQLLSGIVQQQS
NLLRAIEAQQHMLQLTVWGIKQLQARVLALERYLKDQQLLGMWGCSGKLICTTNVPWNTSWSNKSEKDIWDNMTWMQ
WEREISNYTETIYKLLEDSQNQQEPRNEQDLLALDSWNSLWNWFNITKWLWYIK**EVPNSVTGS

>HV1300857_CH848.3.d0700.15.15gp140C

MRVTGILKNYPQWWIWGILGFWMLMNCNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVNNRTVYDSRSNDNVTSINN
TIMGEMKNCSFNTTTEIRDKEKKEYALFYRPDIVPLNETSNTSEYRLINCNTSAVTQACPKVTFEPIPIHYCAPAGY
AILKCNDETFNGTGPCSNVSTVQCTHGIRPVVSTQLLLNGSLAEKEIVIRSENLTNNAKIIIVHLHTPVEIVCTRPG
NNTRKSVRIGPGQTFYATGDIIGDIRQAHCNISEEKWNKTLQKVGKELQKHFPNKTIKYERPAGGDLEITTHSFNCG
GEFFYCNTSKLFNGTYNGTDISTNSSTNSTSTITLQCRIKQIINMWQGVGRAMYAPPIAGNITCKSNITGLLLTRDG
GTNSSEEIFRPAGGDMRDNWRSELYKYKVVEIQPLGIAPTGAKERVVEREKEAAGLGALFLGFLGAAGSTMGAASIT
LTVQARQLLSGIVQQQSNLLRAIEAQQHMLQLTVWGIKQLQARVLALERYLKDQQLLGMWGCSGKLICTTNVPWNTS
WSNKSEKDIWDNMTWMQWEREISNYTETIYKLLEDSQNQQERNEKDLLALDSWNSLWNWFNITKWLWYIK**GT*IR
*PDX

>HV1300858_CH848.3.d0700.15.29gp140C

MRVMGILKNYPQWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSNATVNNRTVYDSRSNDNVTSINN
TIMGEMKNCSFNTTTEIRDKEKKEYALFYRPDIVPLNENETSNTSEYRLINCNTSAVTQACPKVTFEPIPIHYCAPA
GYAILKCNNETFNGTGPCSNVSTVQCTHGIRPVVSTQLLLNGSLAEKEIVIRSENLTNNAKIIIVHLHTPVEIVCTR
PGNNTRKSVRIGPGQTFYATGDIIGDIRQAHCNISEEKWNETLQKVGKELQKHFPNKTIKYAQSAGGDMEITTHSFN
CGGEFFYCNTSNLFNGTYNGTYISTNSSANSTSTITLQCRIKQIINMWQGVGRAMYAPPIAGNITCKSNITGLLLTR
DGGTNNTSNEETFRPAGGDMRDNWRSELYKYKVVEIQPLGIAPTGAKERVVEREKEAAGLGALFLGFLGAAGSTMGA
ASITLTVQARQLLSGIVQQQSNLLRAIEAQQHMLQLTVWGIKQLQARVLALERYLKDQQLLGMWGCSGKLICTTAVP
WDSSWSNKSEKDIWDNMTWMQWEREISNYTETIYKLLEDSQNQQERNEQDLLALDSWNSLWNWFNITNWLWYIK**G
S*IR*PDX

>HV1300859_CH848.3.d0700.27.06gp140C

MRVMGILKNYPQWWIWGILGFWMLMICKGKGNLWVTVYYGVPVWKEAKTTLFCASDAKAYEKEVHNVWATHACVPTD
PSPQELFLENVTENFNMWKNDMVDQMHEDIISLWDQSLKPCVKLTPLCVTLICSNATVNNRTVYEMKNCSFNTTTEI
RDKEKKEYALFYRSDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLHTPVEIVCTRPGNNTRKSVRIGPGQTFYA
TGDIIGEIRQAHCNISESKWNETLQKVGKELQKHFPNKTIKYERSAGGDMEITTHSFNCGGEFFYCNTSKLFNGTYN
GTDISTNSSANSNSTITLQCRIKQIINIWQGVGRAMYAPPIAGNITCKSNITGLLLTRDGGNNNNRNEETFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSEKDIWDNMTW
MQWEREISNYTETIYMLLEDSQRQQERNEKDLLALDSWNSLWNWFNITNWLWYIK**GSRIRLPDXX

>HV1300860_CH848.3.d0794.5.27gp140C

MRVMGIPKNYPQWWIWGILGFWMLMNCNGKENLWVTVYYGVPVWKEAKTTLFCASDARAYEKEVHNVWATHACVPTD
PSPQELVLGNVTENFNMWKNDMVDQMHEDIISLWDQSLKPCVKLTPLCVTLICSNATVDNRTVGEMKNCSFNTTTEI
RDKEKKEYALFYRPDIVPLSETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPNNNTRKSVRIGPGQTFYA
TGDIIGEIKQAHCNISEEKWNETLQKVGKELQKHFPNKIIKYAQSAGGDMEITTHSFNCGGEFFYCNTANLFNGTYN
GTDISTNSSTKSNSTITLQCRIKQIINMWQGVGRAMYAPPIAGNITCRSTIGLLLTRDGGTNSSKTEEEETFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSKTDIWDNMT
WMQWEREISNYTETIYKLLEDSQNQQEPNEQDLLALDSWNSLWNWFNITKWLWYIK**EDPNSVTGS

>HV1300861_CH848.3.d0794.5.41gp140C

MRVMGILKNYPQWWIWGILGFWMLMICNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVKNRTVEEMKNCSFNTTTEI
RDKEKKEYALFYRPDIVPLNNETSNTSEYRLINCNTSAVTQACPKVTFEPIPIHYCAPAGYAILKCNNETFNGTGPC
```

Figure 8 continued

SNVSTVQCTHGIRPVVSTQLLLNGSLAEKEIVIRSENLTNNAKIIIVHLNTPVEIVCTRPNNNTRKSVRIGPGQTFY
ATGDIIGDIRQAHCNISEKEWNDTLQKVGKELQKHFPNKTIEYKQSAGGDMEITTHSFNCGGEFFYCNTSNLFNGTY
NGTYMNISTDSNSTITLQCRIKQIINMWQGVGRAMYAPPIAGNITCRSNITGLLLTRDGGTNSSKTEEETFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSEKDIWDNMTW
MQWEREISNYTETIYKLLEDSQNQQERNEQDLLALDSWNSLWNWFNITKWLWYIK**EVPNSVTGS

>HV1300862_CH848.3.d0836.10.36gp140C

MRVMGILKNYPQWWIWGILGFWMLMNCNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVKNSTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKGIVIRSENLTNNAKIIIVHLNTPVEIVCTRPNNNTRKSVRIGPGQTFY
ATGDIIGDIRQAHCNISESKWNETLQKVGKELQKHFPNKTIKYEQSAGGDMEITTHSFNCGGEFFYCTTSKLFNGTY
NGTDISTNSSANSNPTITLQCRIKQIINMWQGVGRAMYAPPIAGNITCKSNITGLLLTRDGGTNSSGKEEIFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTETIYKLLEDSQNQQERNEQDLLALDSWNSLWNWFNITKWLWYIK**GT*IRLPDX

>HV1300863_CH848.3.d0864.7.26gp140C

MRVTGILKNYPQWWIWGILGFWMLMNCNGKENLWVTVYYGVPVWKEAKTTLFCASDARAYEKEVHNVWATHACVPTD
PSPQELVLGNVTENFNMWKNDMVDQMHEDIISLWDQSLKPCVKLTPLCVTLICSNATVKNSTVDEMKNCSFNTTTEI
RDKEKKEYALFYRPDIVPLNENETSNTSEYRLINCNTSAVTQACPKVTFEPIPIHYCAPAGYAILKCNDETFNGTGP
CSNVSTVQCTHGIRPVVSTQLLLNGSLAEKEIVIRSENLTNNAKIIIVHLNTPVEIVCTRPNNNTRKSVRIGPGQTF
YATGDIIGDIRQAHCNISEKEWNETLQKVGKELQKHFPNKTIKYAQSAGGDMEITTHSFNCGGEFFYCNTANLFNGT
YNGTDISTNSSTKSNSTITLQCRIKQIINMWQGVGRAMYAPPIAGNITCRSTITGLLLTRDGGNNSSKTEEETFRPA
GGDMRDNWRSELYKYKVVEIQPLGIAPTGAKERVVEREKEAAGLGALFLGFLGAAGSTMGAASITLTVQARQLLSGI
VQQQSNLLRAIEAQQHMLQLTVWGIKQLQARVLALERYLKDQQLLGMWGCSGKLICTTNVPWNTSWSNKSTDIWDN
MTWMQWEREISNYTETIYKLLEDSQNQQERNEQDLLALDSWNSLWNWFNITKWLWYIK**GS*IRLPDX

>HV1300864_CH848.3.d0864.7.39gp140C

MRVMGIPKNCPQWWIWGILGFWMLMICNGKGKLWVTIYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVKNSTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLNTPVEIVCTRPNNNTRKSVRIGPGQTFY
ATGDIIGDIRQAHCNISEKEWNDTLQKVGKELQKHFPNKTIEYKQSAGGDMEITTHSFNCGGEFFYCNTAKLFNGTY
NGTDISTNSSADSNSTITLQCRIKQIINMWQGVGRAMYAPPIAGNITCKSHITGLLLTRDGGTNSSEEEEIFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTETIYKLLEDSQNQQERNEQDLLALDSWNSLWNWFNITKWLWYIK**EFGDRDPDX

>HV1300865_CH848.3.d0893.10.06gp140C

MRVTGILKNYPQWWIWGILGFWMLMNCNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVKNSTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLNTPVEIVCTRPNNNTRKSVRIGPGQTFY
ATGDIIGDTRQAHCNISEKKWNETLQKVGIELQKHFPNKTIKYNQSAGGDMEITTHSFNCGGEFFYCNTSNLFNGTY
NGTYISTNSSANSTSTITLQCRIKQIINMWQGVGRAMYAPPIAGNITCRSNITGLLLTRDGGTNSNETETFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSETDIWDNMTW
MQWEREISNYTETIYKLLEDSQNQQEPNEQDLLALDSWNSLWNWFSITKWLWYIK**EFGHRDPDX

>HV1300866_CH848.3.d1120.10.13gp140C

MRVTGILKNYPQWWIWGILGFWMLMNCNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSHATVENSTTEEMKNCSFNTTTEI

Figure 8 continued

RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLHTPVEIVCTRPNNNTRKSVRIGPGQTFY
ATGGIIGEIRQAHCNISKETWNDTLQKVGKELQKHFPNKTIRYNQSAGGDMEITTHSFNCGGEFFYCNTAKLFNSTY
NGTYISTNSTNSTSYITLQCRIKQIINMWQGVGRAMYAPPIAGNITCRSNITGLLLTRDGGTNSSEEEIFRPAGGDM
RDNWRSELYKYKVVEVQPLGIAPTGAKERVVEREKEAAGLGALFLGFLGAAGSTMGAASITLTVQARQLLSGIVQQQ
SNLLRAIEAQQHMLQLTVWGIKQLQARVLALERYLKDQQLLGMWGCSGKLICTTNVPWNTSWSNKSETDIWDNMTWM
QWEREISNYTETIYKLLEDSQNQQERNEQDLLALDSWNSLWNWFSITKWLWYIK**EFGNRDPDXX

>HV1300867_CH848.3.d1120.10.21gp140C

MRVTGILKNYPQWWIWGILGFWMLMICNGEENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLMCSNAIVKNSTTEEMKNCSFNTTTEI
RDKEKKEYALFYRPDIVPLNNKTSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLHTPVQIVCTRPNNNTRKSVRIGPGQTFY
ATGDIIGDPRQAHCNISEKKWNETLQKVGIELQKHFPNKTIKYNQSAGGDMEITTHSFNCGGEFFYCNTAKLFNSTY
NGTYISTNSTDSTSNITLQCRIKQIINMWQGVGRAMYAPPIAGNITCRSNITGLLLTRDGGINNDSNETETFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTETIYKLLEDSQNQQERNEQDLLALDSWNSLWNWFSITKWLWYIK**EFGYRDPDX

>HV1300868_CH848.3.d1120.10.24gp140C

MRVMGILKNYPRWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSTATVNKSTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVHLHTPVEIVCTRPNNNTRKSVRIGPGQTFY
ATGGIVGDIRQAHCNISKGLWNDTLQKVGIELQKHFPNKTIKYNQSAGGDMEITTHSFNCGGEFFYCNTSNLFNGTY
NGTYISTNSSANSTSYITLQCRIKQIINMWQGVGRAMYAPPIAGNITCRSNITGLLLTRDGGTTNNSNETETFRPAG
GDMRDNWRSELYKYKVVEIQPLGIAPTGAKERVVEREKEAAGLGALFLGFLGAAGSTMGAASITLTVQARQLLSGIV
QQQSNLLRAIEAQQHMLQLTVWGIKQLQARVLALERYLKDQQLLGMWGCSGKLICTTNVPWNTSWSNKSETDIWDNM
TWMQWEREISNYTETIYKLLEDSQNQQEPNEQDLLALDSWNSLWNWFSITKWLWYIK**EFGDRVPDX

>HV1300869_CH848.3.d1120.10.32gp140C

MRVTGILKNYPRWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSNAIVENGTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKGIVIRSENLTNNAKIIIVQLNTSVEIVCTRPNNNTRKSVRIGPGQTFY
ATGDIIGDPRQAHCNISKEKWNDTLQKVGKELQKHFPNKTIRYNQSAGGDMEITTHSFNCGGEFFYCNTAKLFNSTY
NGTYISTNSTNSTSNITLQCRIKQIINMWQGVGRAMYAPPIAGNITCRSNITGLLLTRDGGTTNNSNETETFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTGTIYKLLEDSQNQQERNEQDLLALDSWNSLWNWFNITKWLWYIK**EFGDQDPDX

>HV1300870_CH848.3.d1120.10.41gp140C

MRVMGIQKNYPRWWIWGILGFWMLMICNGEGKLWVTVYYGVPVWKEAKTTLFCASDARAYEKEVHNVWATHACVPTD
PSPQELVLGNVTENFNMWKNDMVDQMHEDIISLWDQSLKPCVKLTPLCVTLICSNATVKNSTTEEMKNCSFNTTTEI
RDKEKKEHALFYRPDIVPLNNETGNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVQLNTSVEIVCTRPNNNTRKSVRIGPGQTFY
ATGDIIGDIKQAHCNISEEKWNDTLQKVGIELQKHFPNKTIKYNQSAGGDMEITTHSFNCGGEFFYCNTSKLFNSTY
NGTYISTNSTNSTSYITLQCRIKQIINMWQGVGRAMYAPPIAGNITCRSNITGLLLTRDGGINNDSNETETFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSEMDIWDNMT
WMQWEREISNYTGTIYKLLEDSQNQQERNEQDLLALDSWNSLWNWFNITKWLWYIK**EFGDQVPDX

MRVTGILKNYPRWWIWGILGFWMLMICNGKGKLWVTVYYGVPVWKEAKTTLFCASDARAYEKEVHNVWATHACVPTD
PSPQELVLDNVTENFNMWKNDMVDQMHEDIISLWDQSLKPCVKLTPLCVTLICSIATANGSTVEEMKNCSFNTTTEI
RDKEKKEYALFYRPDIVPLNNKTSNISEYRLINCNTSAVTQACPKVTFEPIPIHYCAPAGYAILKCNNETFNGTGPC
SNVSTVQCTHGIRPVVSTQLLLNGSLAEKEIVIRSENLTNNAKIIVHLHTPVEIVCTRPNNNTRKSVRIGPGQTFY
ATGDIIGNPRQAHCNISKERWNDTLQKVGKELQKHFPNKTIRYNQSAGGDMEITTHSFNCGGEFFYCNTSNLFNSTY
NDTYISTNSSANNSSTITLQCRIKQIINMWQGVGRAMYAPPIAGNITCKSNITGLLLTRDGGTDSNETETFRPAGGD
MRDNWRSELYKYKVVEIQPLGIAPTGAKERVVEREKEAVGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSETDIWDNMTW
MQWEREISNYTGTIYKLLEDSQNQQERNEQDLLALDSWNNLWSWFSITKWLWYIK**EFGDRDLDX

>HV1300872_CH848.3.d1305.10.21gp140C

MRVTGILKNYPRWWIWGILGFWMLMICNGKGKLWVTVYYGVPVWKEAKTTLFCASDAKAYVKEVHNVWATHACVPTD
PSPQELVLDNVTENFNMWKNDMVDQMHEDIISLWDQSLKPCVKLTPLCVTLICSNATVENSTTEEMKNCSFNTTTEI
RDKEKKEHALFYRPDIVPLNNETGNTSEYRLINCNTSAVTQACPKVTFEPIPIHYCAPAGYAILKCNDETFNGTGPC
SKVSTVQCTHGIRPVVSTQLLLNGSLAEKGIVIRSENLTNNAKIIVQLNTSVEIVCTRPNNNTRKSVRIGPGQTFY
ATGDIIGNIRQAHCNISESKWNDTLQKVGIELQKHFPNKTIKYNQSAGGDMEITTHSFNCGGEFFYCNTAKLFNSTY
NGTYISTNSTNSTSKNITLQCRIKQIINMWQGVGRAMYAPPIAGNITCRSNITGLLLTRDGGTTNNSNETETFRPAG
GDMRDNWRSELYKYKVVEVQPLGIAPTGAKERVVEREKEAAGLGALFLGFLGAAGSTMGAASITLTVQARQLLSGIV
QQQSNLLRAIEAQQHMLQLTVWGIKQLQARVLALERYLKDQQLLGIWGCSGKLICTTNVPWNTSWSNKSETDIWGNM
TWMQWEREISNYTETIYKLLEDSQNQQERNEQDLLALDSWNSLWSWFNITKWLWYIK**EFGDRVLDX

>HV1300873_CH848.3.d1305.10.30gp140C

MRVTGILKNYPQWWIWGILGFWMLMTCNGEGNLWVTVYYGVPVWKEAKTTLFCASDAKAYKKEVHNVWATHACVPTD
PSPQELFLENVTENFNMWKNDMVDQMHEDIISLWDQSLKPCVKLTPLCVTLICSTATVNNSTVDEMKNCSFNATTEI
RDKKKKEYALFYRSDVVPLDETNNTSEYRLINCNTSAVTQACPKVTFEPIPIHYCAPAGYAILKCNDETFNGTGPCS
NVSTVQCTHGIRPVVSTQLLLNGSLAEKEIVIRSENLTNNAKIIVHLHTPVEIVCTRPGHNTRKSVRIGPGQTFYA
TGDIIGDIRQAHCNINESEWNETLQKVGKELQKHFPNKTIKYEQSAGGDMEITTHSFNCGGEFFYCNTAELFNGTYN
GTDISTNSSANSTSTITLQCRIKQIINMWQGVGRAMYAPPIAGNITCRSNITGLLLTRDGGINNVSNETETFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSEMDIWNNMT
WMQWEREISNYTETIYMLLEDSQRQQERNEKDLLALDSWNSLWNWFNITNWLWYIK**EFGHRVPDX

>HV1300874_CH848.3.d1305.10.35gp140C

MRVTGIRKNCPQWWIWGILGFWMLMNCNGEGNLWVTVYYGVPVWKEAKTTLFCASDAKAYVKEVHNVWATHACVPTD
PSPQELFLKNVTENFNMWKNDMVDQMHEDIISLWDQSLKPCVKLTPLCVTLICSTATVNNSKFEEMKNCSFNTTTEI
RDKEKKEYALFYRPDIVPLDNETSNISEYRLINCNTSAVTQACPKVTFEPIPIHYCAPAGYAILKCNDETFNGTGPC
SNVSTVQCTHGIRPVVSTQLLLLNGSLAEKEIVIRSENLTNNAKIIVHLHTPVEIVCTRPNNNTRKSVRIGPGQTFY
ATGDIIGNPRQAHCNISKERWNDTLQKVGKELQKHFPNKTIKYNQSAGGDMEITTHSFNCGGEFFYCNTSNLFNSTY
NDTYISTNSTNSTSYITLQCRIKQIINMWQGVGRAMYAPPIAGNITCKSNITGLLLTRDGGINKDSNETETFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTGTIYKLLEDSQNQQERNEQDLLALDSWNLWNWFSITKWLWYIK**EFGHQDPDX

>HV1300875_CH848.3.d1432.5.18gp140C

MRVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEEMSNATVKNSTTE
EMSNATVKNSTTEEMKNCSFNTTTEIRDKEKKEYALFYRPDVVPLDETNNTSKYPLINCNTSAVTQACPKVTFEPIP
IHYCAPAGYAILKCNDETFNGTGPCSKVSTVQCTHGIRPVVSTQLLLNGSLAEKEIVIRSENLTNNAKIIVHLHTP
VEIVCTRPYNNTRKSVRIGPGQTFYATGDIIGDPRQAHCNISKEIWNKTLQEVGKELQKHFPNKTIRYNQSAGGDME
ITTHSFNCGGEFFYCNTSNLFNSTYNDTYISPNSTNSTSTITLQCRIKQIINMWQGVGRAMYAPPIAGNITCKSNIT
GLLLTRDGGINNVSNETETFRPAGGDMRDNWRSELYKYKVVEVQPLGLAPTGAKERVVEREKEAAGLGALFLGFLGA
AGSTMGAASITLTVQARQLLSGIVQQQSNLLRAIEAQQHMLQLTVWGIKQLQARVLALERYLKDQQLLGMWGCSGKL
ICTTNVPWNTSWSNKSETDIWDNMTWMQWEREISNYTGTIYKLLEDSQNQQERNEQDLLALDSWNSLWNWFSITKWL
WYIK**EFGHQVPDX

MRVTGILKNYPRWWIWGILGFWMLMNCNGEGKLWVTVYYGVPVWKEAKTTLFCASDAKAYVKEVHNVWATHACVPTD
PSPQELFLKNVTENFNMWKNDMVDQMHEDIISLWDQSLKPCVKLTPLCVTLNCSNATVNNTTDYDSRSNANVTNITN
TIKEEVKNCSFKTTTEIRDKEKKEHALFYRPDIVPLNSETGNTSEYRLINCNTSAVTQACPKVTFEPIPIHYCAPAG
YAILKCNDETFNGTGPCSKVSTVQCTHGIRPVVSTQLLLNGSLAEKGIVIRSENLTNNAKIIIVQLNTSVEIVCTRP
GNNTRKSMRIGPGQTFYATGDIIGDIRQAHCNISESKWNDTLQKVGIELQKHFPNKTIKYNQSAGGDMEITTHSFNC
GGEFFYCNTAKLFNSTYNGTYISTNSSANSTSKNITLQCRIKQIINMWQGVGRAMYAPPIAGNITCRSNITGLLLTR
DGGIHNDSNETETFRPAGGDMRDNWRSELYKYKVVEIQPLGIAPTGAKERVVGREKEAAGLGALFLGFLGAAGSTMG
AASITLTVQARQLLSGIVQQQSNLLRAIEAQQHMLQLTVWGIKQLQARVLALERYLKDQQLLGIWGCSGKLICTTNV
PWNTSWSNKSETDIWENMTWMQWEREISNYTETIYKLLEDSQNQQERNEQDLLALDSWNSLWNWFSITKWLWYIK**
EFGHRDLDX

>HV1300877_CH848.3.d1432.5.41gp140C

MRVTGILRNYPQWWIWGILGFWMLMNCGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEEMSTALVKNSTTE
AMKNCSFNTTTEIRDKEKKEYALFYRPDIVPLNNETGNISEYRLINCNTSAVTQACPKVTFEPIPIHYCAPAGYAIL
KCNDETFNGTGPCSNVSTVQCTHGIRPVVSTQLLLNGSLAKEEIVIRSENLTNNAKIIIVHLHTPVEIVCTRPNNNT
RKSVRIGPGQTFYATGDIIGDPRKAHCNISEKDWNKTLQEVGKELQKHFPNKTIRYNQSAGGDMEITTHSFNCGGEF
FYCNTSKLFNSTYNDTYISTNSSANNSSTITLQCRIKQIINMWQGVGRAMYAPPIAGNITCKSNITGLLLTRDGGPD
SNETETFRPAGGDMRDNWRSELYKYKVVEVQPLGIAPTGAKERVVEREKEAAGLGALFLGFLGAAGSTMGAASITLT
VQARQLLSGIVQQQSNLLRAIEAQQHMLQLTVWGIKQLQARVLALERYLKDQQLLGIWGCSGKLICTTNVPWNTSWS
NKSETDIWGNMTWMQWEREISNYTETIYKLLEDSQNQQERNEQNLLALDSWNSLWNWFSITKWLWYIK**EFGHRVL
DX

>HV1300878_CH848.3.d1432.5.50gp140C

MRVTGILKNYPQWWIWGILGFWMLMNCGEGNLWVTVYYGVPVWKEAKTTLFCASDAKAYEKEVHNVWATHACVPTD
PSPQELFLENVTENFNMWKNDMVDQMHEDIISLWDQSLKPCVKLTPLCVTLICSTATVNNSTVDEMKNCSFNATTEI
RDKKKKEYALFYRSDVVPLDETNNTSEYRLINCNTSAVTQACPKVTFEPIPIHYCAPAGYAILKCNDETFNGTGPCS
NVSTVQCTHGIRPVVSTQLLLNGSLAEKEIVIRSENLTNNAKIIIVHLHTPVEIVCTRPGHNTRKSVRIGPGQTFYA
TGDIIGDIRQAHCNINESKWNETLQKVGNELQKHFPNKTIKYEQAAGGDMEITTHSFNCGGEFFYCNTANLFNGTYN
GTDISTNSSANSTSTITLQCKIKQIINMWQGVGRAMYAPPIAGNITCRSNITGLLLTRDGGINNVSNETETFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSEMDIWNNMT
WMQWEREISNYTETIYMLLEDSQRQQERNEKDLLALDSWNSLWNWFNITNWLWYIK**EFGNRVPDXX

>HV1300879_CH848.3.d1432.5.56gp140C

MRVTGILKNYPRWWIWGILGFWMLMNCGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEEMSNATVKNSTTE
EMKNCSFNTTTEIRDKEKKEYALFYRPDVVPLDETNNTSKYRLINCNTSAVTQACPKVTFEPIPIHYCAPAGYAILK
CNDETFNGTGPCSNVSTVQCTHGIRPVVSTQLLLNGSLAEKEIVIRSENLTNNAKIIIVHLHTPVEIVCTRPYNNTR
KSVRIGPGQTFYATGDIIGDPRQAHCNISKEIWNKTLQEVGKELQKHFPNKTIRYNQSAGGDMEITTHSFNCGGEFF
YCNTAKLFNSTYNDTYKSTNSSANNSSIITLQCRIKQIINMWQGVGRAMYAPPIAGNITCKSNITGLLLTRDGGINN
VSNETETFRPAGGDNWRSELYKYKVVEVQPLGIAPTGAKERVVEREKEAVGLGALFLGFLGAAGSTMGAASITLTVQ
ARQLLSGIVQQQSNLLRAIEAQQHMLQLTVWGIKQLQARVLALERYLKDQQLLGMWGCSGKLICTTNVPWNTSWSNK
SETDIWDNMTWMQWEREISNYTGTIYKLLEDSQNQQERNEQDLLALDSWNSLWNWFSITKWLWYIK**EFGNQDPDX

>HV1300880_CH848.3.d1621.4.12gp140C

MRVTGILKNYPRWWIWGILGFWMLMNCGEGKLWVTVYYGVPVWKEAKTTLFCASDAKAYVKEVHNVWATHACVPTD
PSPQELFLKNVTENFNMWKNDMVDQMHEDIISLWDQSLKPCVKLTPLCVTLNCSNATVNSTTDYDSRSNDTVTNITN
TIKEEVKNCSFKTTTEIRDKEKKEHALFYRPDIVPLNSETGNTSEYRLINCNTSAVTQACPKVTFEPIPIHYCAPAG
YAILKCNDETFNGTGPCSNVSTVQCTHGIRPVVSTQLLLNGSLAKEEIVIRSENLTNNAKTIIVHLHTPVEIVCTRP
GNNTRKSMRIGPGQTFYATGDIIGDIRQAHCNISEEKWNKTLQEVGKELQKHFPNRTIKYNQSAGGDMEITTHSFNC
GGEFFYCNTSKLFNSTYNDTYISTNSTNSSANNSSIITLQCRIKQIINMWQGVGRAMYAPPIAGNIICKSNITGLLL
TRDGGPDSNKTETETFRPAGGDMRDNWRSELYKYKVVEVQPLGIAPTGAKERVVEREKEAAGLGALFLGFLGAAGSTMG

Figure 8 continued

AASITLTVQARQLLSGIVQQQSNLLRAIEAQQHMLQLTVWGIKQLQARVLALERYLKDQQLLGIWGCSGKLICTTNV
PWNTSWSNKSETDIWGNMTWMQWEREISNYTETIYKLLEDSQNQQERNEQDLLALDSWNSLWSWFNITKWLWYIK**
EFGNQVPDX

>HV1300881_CH848.3.d1621.4.15gp140C

MPVTGILKNCPLWWIWGILGFWMLMNCNGEGNLWVTVYYGVPVWKEAKTTLFCASDAKAYKKEVHNVWATHACVPTD
PNPQEMFLKNVTENFNMWKNDMVDQMHEDIISLWDQSLKPCVKLTPLCVTLNCSNATVNSTTDYDSRSNDSVTNITN
TIKEEVKNCSFKTTTEIRDKEKKEHALFYRPDIVPLNSETGNISEYRLINCNTSAVTQACPKVTFEPIPIHYCAPAG
YAILKCNDETFNGTGPCSNVSTVQCTHGIRPVVSTQLLLNGSLAKEEIVIRSENLTNNAKIIIVQLNTSVEIVCTRP
GNNTRKSVRIGPGQTFYATGDIIGDIRQAHCNISEKKWNETLQRVGIELQKHFPNKTIKYNQSAGGDMEITTHSFNC
GGEFFYCNTAKLFNSTYNGTYINTTSINSTLNITLQCRIKQIINMWQGVGRAMYAPPIAGNITCRSNITGLLLTRDG
GIHNDSNETETFRPAGGDMRDNWRSELYKYKVVEVQPLGIAPTGAKERVVEREKEAAGLGALFLGFLGAAGSTMGAA
SITLTVQARQLLSGIVQQQSNLLRAIEAQQHMLQLTVWGIKQLQARVLALERYLKDQQLLGIWGCSGKLICTTNVPW
NTSWSNKSETDIWGNMTWMQWEREISNYTETIYKLLEDSQNQQERNEQDLLALDSWNSLWSWFNITKWLWYIK**EF
GNRDLDX

>HV1300882_CH848.3.d1621.4.25gp140C

MRVTGILKNYPQWWIWGILGFWMLMNCNGEGNLWVTVYYGVPVWKEAKTTLFCASDAKAYEKEVHNVWATHACVPTD
PSPQELFLENVTENFNMWKNDMVDQMHEDIISLWDQSLKPCVKLTPLCVTLICSTATVNNSTVDEMKNCSFNATTEI
RDKKKKEYALFYRSDVVSLDETNNTSEYRLINCNTSAVTQACPKVTFEPIPIHYCAPAGYAILKCNDETFNGTGPCS
NVSTVQCTHGIRPVVSTQLLLNGSLAKEEIVIRSENLTNNAKTIIVHLHAPVEIVCTRPGHNTRKSVRIGPGQTFYA
TGDIIGNIRQAHCNINESEWNETLQKVGKELRKHFPNKTIKYEQSAGGDMEITTHSFNCGGEFFYCNTANLFNGTYN
GTDISTNSSADRNSTITLECKIKQIINMWQGVGRAMYAPPIAGNITCRSNITGLLLTRDGGINNVSNATETFRPAGG
DMRDNWRSELYKYKVVEVQPLGIAPTGAKERVVEREKEAVGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSEMDIWNNMT
WMQWEREISNYTETIYMLLEDSQRQQERNEKDLLALDSWNSLWNWFNITNWLWYIK**EFGNRVLDX

>HV1300883_CH848.3.d1621.4.31gp140C

MRVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSNATVENSTEAMKNCSF
NTTTEIRDKIKKEPALFYRPDIVPLNDETNNTSKYRLINCNTSAVTQACPKVTFEPIPIHYCAPAGYAILKCNDETF
NGTGPCSNVSTVQCTHGIRPVVSTQLLLNGSLAKEEIVIRSENLTNNAKIIIVHLHTPVQIVCTRPYNNTRKSVRIG
PGQTFYATGDIIGDPRKAHCNISEKDWNKTLQEVGKELQKHFPNKTIRYNQSAGGDMEITTHSFNCGGEFFYCNTSK
LFNSTYNDTYISTNSTNSSANNSSIITLQCRIKQIINMWQGVGRAMYAPPIAGNITCKSNITGLLLTRDGGPDNKTE
TFRPAGGDMRDNWRSELYKYKVVEVQPLGIAPTGAKERVVEREKEAVGLGALFLGFLGAAGSTMGAASITLTVQARQ
LLSGIVQQQSNLLRAIEAQQHMLQLTVWGIKQLQARVLALERYLKDQQLLGIWGCSGKLICTTNVPWNTSWSNKSET
DIWGNMTWMQWEREISNYTETIYKLLEDSQNQQERNEQDLLALDSWNSLWSWFNITKWLWYIK**EFGYRVPDXX

>HV1300884_CH848.3.d1621.4.44gp140C

MPVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEKMSNVTVNNITIE
EMKNCSFNTTTEIRDKIKKERALFYRPDIVPLNDETNNTSKYRLINCNTSAVTQACPKVTFEPIPIHYCAPAGYAIL
KCNDETFNGTGPCSNVSTVQCTHGIRPVVSTQLLLNGSLAKEEIVIRSENLTNNAKIIIVHLHAPVEIVCTRPYNNT
RKSVRIGPGQTFYATGDIIGDPRQAHCNISKEIWNKTLQEVGKELQKHFPNKTIRYNQSAGGDMEITTHSFNCGGEF
FYCNTSNLFNSTYNDTYISPNSTNSTSIITLQCKIKQIINMWQGVGRAMYAPPIAGNITCKSNITGLLLTRDGGINN
VSNETETFRPAGGDMRDNWRSELYKYKVVEVQPLGIAPTGAKERVVEREKEAVGLGALFLGFLGAAGSTMGAASITL
TVQARQLLSGIVQQQSNLLRAIEAQQHMLQLTVWGIKQLQARVLALERYLKDQQLLGIWGCSGKLICTTNVPWNTSW
SNKSETDIWNNMTWMQWEREISNYTGTIYKLLEDSQNQQERNEKDLLALDSWNSLWSWFNITKWLWYIK**EFGYQD
PDX

>HV1300885_CH848.3.d1621.4.46gp140C

MRVMGILKNYPRWWIWGILGFWMLMICNGKGKLWVTVYYGVPVWKEAKTTLFCASDAKAYVKEVHNVWATHACVPTD
PSPQELVLDNVTENFNMWKNDMVDQMHEDIISLWDQSLKPCVKLTPLCVTLNCSNAIVKNSTTEELSNALARNSTTE
EMKNCSFNTTTEIRDKEKKEYALFYRPDIVPLNNKTSNISEYRLINCNTSTVTQACPKVTFEPIPIHYCAPAGYAIL

Figure 8 continued

KCNNETFNGTGPCSNVSTVQCTHGIRPVVSTQLLLNGSLAKEGIVIRSENLTNNAKIIIVQLNANASVEIVCTRPNN
NTRKSVRIGPGQTFYATGDIIGNIRQAHCNISEKKWNETLQKVGIELQKHFPNKTIKYNQSAGGDMEITTHSFNCGG
EFFYCNTAKLFNSTYNGTYISTNSINSTLNITLQCRIKQIINMWQGVGRAMYAPPIAGNITCRSNITGLLLTRDGGI
HNDSNETETFRPAGGDMRDNWRSELYKYKVVEIQPLGIAPTGAKERVVEREKEAAGLGALFLGFLGAAGSTMGAASI
TLTVQARQLLSGIVQQQSNLLRAIEAQQHMLQLTVWGIKQLQARVLALERYLKDQQLLGIWGCSGKLICTTNVPWNT
SWSNKSETDIWDNMTWMQWEREISNYTGTIYKLLEESQNQQERNEQDLLALDSWNSLWNWFNITKWLWYIK**EFGY
QVPDX

>HV1300886_CH848.3.d1635.10.35gp140C

MRVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEEISNATVKNITIK
EMKNCSFNTTTEIRDKIKKERALFYRTDIVPLNKETGNISEYRLINCNTSAVTQACPKVTFEPIPIHYCAPAGYAIL
KCNDETFNGTGPCSNVSTVQCTHGIRPVVSTQLLLNGSLAEKEIVIRSENLTNNAKIIIVHLHNPVEIVCTRPYNNT
RKSVRIGPGQTFYATGDIIGDPRQAHCNISKEEWNKTLQEVGKELQKHFPNKTIRYNQSAGGDMEITTHSFNCGGEF
FYCNTSNLFNSTYNDTYISPNSTNSTSIITLQCRIKQIINMWQGVGRAMYAPPIAGNITCKSNITGLLLTRDGGINN
VSNETETFRPAGGDMRDNWRSELYKYKVVEVQPLGIAPTGAKEPVVERGKEAAGLGALFLGFLGAAGSTMGAASITL
TVQARQLLSGIVQQQSNLLRAIEAQQHMLQLTVWGIKQLQARVLALERYLKDQQLLGIWGCSGKLICTTNVPWNTSW
SNKSEMDIWNNMTWMQWEREISNYTGTIYKLLEDSQNQQERNEQDLLALDSWNSLWNWFDITKWLWYIK**EFGYRD
LDX

>HV1300887_CH848.3.d1651.7.34gp140C

MRVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEKMSNVTVNNITIE
EMKNCSFNTTTEIRDKIKKERALFYRPDIVPLNDETNNTSKYRLINCNTSAVTQACPKVTFEPIPIHYCAPAGYAIL
KCNDETFNGTGPCSNVSTVQCTHGIRPVVSTQLLLNGSLAEKEIVIRSENLTNNVKTIIVHLHAPVEIVCTRPYNNT
RKSVRIGPGQTFYATGDIIGDPRKAHCNISEKDWNKTLQEVGKELQKHFPNKTIRYNQSAGGDMEITTHSFNCGGEF
FYCNTSKLFNSTYNDTYISTNSTNSSANNSSIITLQCRIKQIINMWQGVGRAMYAPPIAGNITCKSNITGLLLTRDG
GPDNKTETFRPAGGDMRDNWRSELYKYKVVEVQPLGIAPTGAKERVVEREKEAVGLGALFLGFLGAAGSTMGAASIT
LTVQARQLLSGIVQQQSNLLRAIEAQQHMLQLTVWGIKQLQARVLALERYLKDQQLLGIWGCSGKLICTTNVPWNTS
WSNKSETDIWGNMTWMQWEREISNYTETIYKLLEDSQNQQERNEQDLLALDSWNSLWSWFNITKWLWYIK**EFGYR
VLDX

>HV1300888_CH848.3.d1651.7.50gp140C

MRVMGILKNYPRWWIWGILGFWMLMICNGKGKLWVTVYYGVPVWKEAKTTLFCASDAKAYVKEVHNVWATHACVPTD
PSPQELVLDNVTENFNMWKNDMVDQMHEDIISLWDQSLKPCVKLTPLCVTLNCSNAIVKNSTTEELSNALARNSTTE
EMKNCSFNTTTEIRDKEKKEYALFYRPDIVPLNNKTSNISEYRLINCNTSTVTQACPKVTFEPIPIHYCAPAGYAIL
KCNNETFNGTGPCSNVSTVQCTHGIRPVVSTQLLLNGSLAEKEGIVIRSENLTNNAKIIVQLNANASVEIVCTRPNN
NTRKSVRIGPGQTFYATGDIIGNIRQAHCNISEKKWNETLQKVGIELQKHFPNKTIKYNQSAGGDMEITTHSFNCGG
EFFYCNTTKLFNSTYNGTYISTNSINSTLNITLQCRIKQIINMWQGIGRAMYAPPIAGNITCRSNITGLLLTRDGGI
HNDSNETETFRPAGGDMRDNWRSELYKYKVVEIQPLGIAPTGAKERVVERGKEAAGLGALFLGFLGAAGSTMGAASI
TLTVQARQLLSGIVQQQSNLLRAIEAQQHMLQLTVWGIKQLQARVLALERYLKDQQLLGIWGCSGKLICTTNVPWNT
SWSNKSEMDIWDNMTWMQWEREISNYTGTIYKLLEDSQNQQERNEQDLLALDSWNSLWNWFDITKWLWYIK**GDRD
PNSDX

>HV1300889_CH848.3.d1651.10.04gp140C

MRVTGILKNCPLWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTATVENSTEAMKNCSF
NTTTEIRDKIKKERALFYRPDIVPLNNETGNISEYRLINCNTSAVTQACPKVTFEPIPIHYCAPAGYAILKCNDETF
NGTGPCSNVSTVQCTHGIRPVVSTQLLLNGSLAEKEIVIRSENLTNNAKIIIVHLHNPVEIVCTRPYNNTRKSVRIG
PGQTFYATGDIIGDPRKAHCNISKEEWNKTLQEVGKELQKHFPNKTIRYNQSAGGDMEITTHSFNCGGEFFYCNTSN
LFNSTYNDTYISPNSTNSTSIITLQCRIKQIINMWQGVGRAMYAPPIAGNITCKSNITGLLLTRDGGPESNETETFR
PAGGDMRDNWRSELYKYKVVEVQPLGIAPTGAKERVVEREKEAAGLGALFLGFLGAAGSTMGAASITLTVQARQLLS
GIVQQQSNLLRAIEAQQHMLQLTVWGIKQLQARVLALERYLKDQQLLGIWGCSGKLICTTNVPWNTSWSNKSETDIW
GNMTWMQWEREISNYTETIYKLLEDSQNQQERNEQDLLALDSWNSLWSWFNITKWLWYIK**GHRDPNSDXX

MRVTGILKNCPLWWIWGILGFWMLMNCGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSNATVGNSTEAMKNCSF
NTTTEIRDKIKKERALFYRPDIVPLNDETNNTSKYRLINCNTSAVTQACPKVTFEPIPIHYCAPAGYAILKCNDETF
NGTGPCSNVSTVQCTHGIRPVVSTQLLLNGSLAEKEIVIRSENLTNNVKIIIVHLHTPVQIVCTRPYNNTRKSVRIG
PGQTFYATGDIIGDPRKAHCNISEKDWNKTLQEVGKELQKHFPNKTIRYNQSAGGDMEITTHSFNCGGEFFYCNTSK
LFNSTYNDTYISTNSTNSSANNSSIITLQCRIKQIINMWQGVGRAMYAPPIAGNITCKSNITGLLLTRDGGPDNKTE
TFRPAGGDMRDNWRSELYKYKVVEVQPLGIAPTGAKERVVEREKEAVGLGALFLGFLGAAGSTMGAASITLTVQARQ
LLSGIVQQQSNLLRAIEAQQHMLQLTVWGIKQLQARVLALERYLKDQQLLGIWGCSGKLICTTNVPWNTSWSNKSET
DIWGNMTWMQWEREISNYTETIYKLLEDSQNQQERNEQDLLALDSWNSLWSWFNITKWLWYIK**GNRDPNSDXX

>HV1300891_CH848.3.d1720.5gp140C

MRVTGILKNCPLWWIWGILGFWMLMNCGEGNLWVTVYYGVPVWKEAKTTLFCASDAKAYVKEVHNVWATHACVPTD
PSPQELVLDNVTENFNMWKNDMVDQMHEDIISLWDQSLKPCVKLTPLCVTLNCSNAIVPNSTTEKMSDALDRNSTTE
EMKNCSFNTTTEIRDKEKKEYALFYRPDIVPLNNKTSNISEYRLINCNTSTVTQACPKVTFEPIPIHYCAPAGYAIL
KCNNETFNGTGPCSNVSTVQCTHGIRPVVSTQLLLNGSLAKEEIVIRSENLTNNAKIIIVQLNANASVEIVCTRPNN
NTRKSVRIGPGQTFYATGDIIGDIRQAHCNISEKKWNETLQQVGIELQKHFPNKTIKYNQSAGGDMEITTHSFNCGG
EFFYCNTAKLFNSTYNGTYISTDSINSTLNITLQCRIKQIINMWQGVGRAMYAPPIAGNITCRSNITGLLLTRDGGI
HNDSNVTETFRPAGGDMRDNWRSELYKYKVVEIQPLGIAPTGAKERVVGREKEAAGLGALFLGFLGAAGSTMGAASI
TLTVQARQLLSGIVQQQSNLLRAIEAQQHMLQLTVWGIKQLQARVLALERYLKDQQLLGIWGCSGKLICTTNVPWNT
SWSNKSETDIWDNMTWMQWEREISNYTGTIYKLLEESQNQQERNEQDLLALDSWNSLWSWFNITKWLWYIK**GYRD
PNSDX

>HV1301062, CH0848.3.D0526.25.26gp140C

MRVMGILKNYPQWWIWGILGFWMLMICNGKGNLWVTVYYGVPVWKEAKTTLFCASDARAYEKEVHNVWATHACVPTD
PSPQELFLENVTENFNMWKNDMVDQMHEDIISLWDQSLKPCVKLTPLCVTLNCSNVNVTRSNVNVTNITNTIKGEMK
NCSFNTTTEIRDKEKKEYALFYRSDVVPLNETSNTSEYRLINCNTSAVTQACPKVTFEPIPIHYCAPAGYAILKCNN
ETFNGTGPCSNVSTVQCTHGIRPVVSTQLLLNGSLAEKEIVIRSENLTNNAKIIIVHLHTPVEIVCTRPGNNTRKSV
RIGPGQTFYATGDIIGDIRQAHCNISEEKWNKTLHEVSKELQKHFPNKTIKYAQSAGGDMEITTHSFNCGGEFFYCN
TSNLFNGTYNGTYISTNSSANSNSTITLQCRIKQIINMWQGVGRAMYAPPIAGNITCRSNITGLLLTRDGGTKNNKT
EETFRPAGGDMRDNWRSELYKYKVVEIQPLGIAPTGAKERVVEREKEAAGLGALFLGFLGAAGSTMGAASITLTVQA
RQLLSGIVQQQSNLLRAIEAQQHMLQLTVWGIKQLQARVLALERYLKDQQLLGMWGCSGKLICTTNVPWNTSWSNKS
EKDIWDNMTWMQWEREISNYTETIYMLLEDSQRQQERNEKDLLALDSWNSLWNWFNITNWLWYIK**GIX

>HV1301063, CH0848.3.D0700.15.34gp140C

MRVMGILKNYPQWWIWGILGFWMLMICNGKGKLWVTVYYGVPVWKEAKTTLFCASDARAYEKEVHNVWATHACVPTD
PSPQELVLGNVTENFNMWKNDMVDQMHEDIISLWDQSLKPCVKLTPLCVTLICSNATVNNRTMGEMKNCSFNTTTEI
RDKEKKEYALFYKPDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPNNNTRKSVRIGPGQTFYA
TGGIIGDIRQAHCNISEGQWNETLQKVGKELQKHFPNKTIKYEQSAGGDMEITTHSFNCGGEFFYCNTSKLFNGTYN
GTYISTNSSTNSTSTITLQCRIKQIINMWQGVGRAMYAPPIAGNITCKSNITGLLLTRDGGTNSSEEIFRPAGGDMR
DNWRSELYKYKVVEIQPLGIAPTGAKERVVEREKEAAGLGALFLGFLGAAGSTMGAASITLTVQARQLLSGIVQQQS
NLLRAIEAQQHMLQLTVWGIKQLQARVLALERYLKDQQLLGMWGCSGKLICTTNVPWNTSWSNKSEKDIWDNMTWMQ
WEREISNYTETIYKLLEDSQNQQERNEQDLLALDSWNSLWNWFNITKWLWYIK**GIX

>HV1301064, CH0848.3.D0780.25.05gp140C

MRVMGILKNYPQWWIWGILGFWMLMNCNGKENLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVNNRTDYDTPRSNVNVTNITN
TIKGEMKNCSFNTTTEIRDKEKKEYALFYRPDIVPLNENETSNTSEYRLINCNTSAVTQACPKVTFEPIPIHYCAPA
GYAILKCNDETFNGTGPCSNVSTVQCTHGIRPVVSTQLLLNGSLAEKEIVIRSENLTNNAKIIIVHLNTSVEIVCTR
PGNNTRKSVRIGPGQTFYATGDIIGDIRQAHCNISESKWNETLQKVGIELQKHFPNKTIKYEQSAGGDMEITTHSFN
CGGEFFYCNTSNLFNGTYNGTYISTNSSANSTSTITLQCRIKQIINMWQGVGRAMYAPPIAGNITCKSNITGLLLTR
DGGTNSSEEIFRPAGGDMRDNWRSELYKYKVVEIQPLGIAPTGAKERVVEREKEAAGLGALFLGFLGAAGSTMGAAS

Figure 8 continued

ITLTVQARQLLSGIVQQQSNLLRAIEAQQHMLQLTVWGIKQLQARVLALERYLKDQQLLGIWGCSGKLICTTNVPWN
TSWSNKSEKDIWDNMTWMQWEREISNYTETIYKLLEDSQNQQERNEQDLLALDSWNSLWNWFNITKWLWYIK**GIX

>HV1301065, CH0848.3.D0700.15.05gp140C

MRVMGILKNYPQWWIWGILGFWMLMICNGKGKLWVTVYYGVPVWKEAKTTLFCASDAKAYKKEVHNVWATHACVPTD
PSPQELVLGNVTENFNMWKNDMVDQMHEDIISLWDQSLKPCVKLTPLCVTLICSNATVNNRTVYDSRSNDNVTSINN
TIMGEMKNCSFNTTTEIRDKEKKEYALFYRPDIVPLNENETSNTSEYRLINCNTSAVTQACPKVTFEPIPIHYCAPA
GYAILKCNNETFNGTGPCSNVSTVQCTHGIRPVVSTQLLLNGSLAEKEIVIRSENLTNNAKIIIVHLHTPVEIVCTR
PGNNTRKSVRIGPGQTFYATGDIIGDIRQAHCNISEEKWNETLQKVGIELQKHFPNKTIKYEQSAGGDMEITTHSFN
CGGEFFYCNTSNLFNGTYNGTYISTNSSANSTSTITLQCRIKQIINMWQGVGRAMYAPPIAGNITCKSNITGLLLTR
DGGTNNTSNEETFRPAGGDMRDNWRSELYKYKVVEIQPLGIAPTGAKERVVEREKEAAGLGALFLGFLGAAGSTMGA
ASITLTVQARQLLSGIVQQQSNLLRAIEAQQHMLQLTVWGIKQLQARVLALERYLKDQQLLGMWGCSGKLICTTAVA
WNTSWSNKSEKDIWDNMTWMQWEREISNYTETIYKLLEDSQNQQERNEQDLLALDSWNSLWNWFNITKWLWYIK**G
IX

>HV1301066, CH0848.3.D0794.3.03gp140C

MRVMGILKNYPQWWIWGILGFWMLMICNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVDNRTVGEMKNCSFNTTTEI
RDKEKKEYALFYRPDIVPLNNETSNTSEYRLINCNTSAVTQACPKVTFEPIPIHYCAPAGYAILKCNNETFNGTGPC
SNVSTVQCTHGIRPVVSTQLLLNGSLAEKGIVIRSENLTNNAKIIIVQLNTSVEIVCTRPNNNTRKSVRIGPGQTFY
ATGDIIGEIRQAHCNISEEKWNETLQKVGKELQKHFPNKTIKYAQSAGGDMEITTHSFNCGGEFFYCNTAKLFNGTY
NGTDISTNSSTNSNPTITLQCRIKQIINMWQGVGRAMYAPPIAGNITCKSNITGLLLTRDGGTNSSGKEEIFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTETIYKLLEDSQNQQERNEQDLLALDSWNSLWNWFNITKWLWYIK**GIX

>HV1301067, CH0848.3.D0836.10.31gp140C

MRVMGILKNYPQWWIWGILGFWMLMICNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNATVKNSTVEEMKNCSFNTTTEI
RDKEKKEYALFYRPDIVPLNNETSNTSEYRLINCNTSAVTQACPKVTFEPIPIHYCAPAGYAILKCNDETFNGTGPC
SNVSTVQCTHGIRPVVSTQLLLNGSLAEKGIVIRSENLTNNAKIIIVHLHTPVEIVCTRPNNNTRKSVRIGPGQTFY
ATGDIIGDIRQAHCNISESKWNETLQKVGKELQKHFPNKTIKYAQSAGGDMEITTHSFNCGGEFFYCNTAKLFNGTY
NGTDISTNSSTNSNPTITLQCRIKQIINMWQGVGRAMYAPPIAGNITCKSNITGLLLTRDGGTNSSGKEEIFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTETIYKLLEDSQNQQERNEQDLLALDSWNSLWNWFNITKWLWYIK**GIX

>HV1301068, CH0848.3.D0808.15.27gp140C

MRVMGILKNYPQWWIWGILGFWMLMICNGKGKLWVTVYYGVPVWKEAKTTLFCASDARAYEKEVHNVWATHACVPTD
PSPQELFLDNVTENFNMWKNDMVDQMHEDIISLWDQSLKPCVKLTPLCVTLICSNATVKNRTVYEMKNCSFNTTTEI
RDKEKKEYALFYRPDIVPLNENETSNTSEYRLINCNTSAVTQACPKVTFEPIPIHYCAPAGYAILKCNNETFNGTGP
CSNVSTVQCTHGIRPVVSTQLLLNGSLAEKEIVIRSENLTNNAKIIIVHLNTPVEIVCTRPNNNTRKSVRIGPGQTF
YATGDIIGDIRQAHCNISEKEWNETLQKVGKELQKHFPNKTIKYEQSAGGDMEITTHSFNCGGEFFYCNTSNLFNGT
YNGTDISTNSSAKSNSTITLQCRIKQIINMWQGVGRAMYAPPIAGNITCKSNITGLLLTRDGGNSSKTEEETFRPAG
GDMRDNWRSELYKYKVVEIQPLGIAPTGAKERVVEREKEAAGLGALFLGFLGAAGSTMGAASITLTVQARQLLSGIV
QQQSNLLRAIEAQQHMLQLTVWGIKQLQARVLALERYLKDQQLLGMWGCSGKLICTTNVPWNTSWSNKSEMDIWDNM
TWMQWEREISNYTETIYMLLEDSQRQQERNEKDLLALDSWNSLWNWFNITKWLWYIK**GIX

>HV1301069, CH0848.3.D0949.10.18gp140C

MRVMGILKNYPQWWIWGILGFWMLMICNGKGKLWVTVYYGVPVWKEAKTTLFCASDARAYEKEVHNVWATHACVPTD
PSPQELFLDNVTENFNMWKNDMVDQMHEDIISLWDQSLKPCVKLTPLCVTLICSTATVDNSTVEEMKNCSFNTTTEI
RDKEKKEYALFYRPDIVPLNENETSNTSEYRLINCNTSAVTQACPKVTFEPIPIHYCAPAGYAILKCNDETFNGTGP
CSNVSTVQCTHGIRPVVSTQLLLNGSLAEKEIVIRSENLTNNAKIIIVHLHTPVEIVCTRPNNNTRKSVRIGPGQTF
YATGDIIGEIRQAHCNISEEEWNETLQKVGKELQKHFPNKTIKYEQSAGGDMEITTHSFNCGGEFFYCNTANLFNGT

Figure 8 continued

YNGTDISTNSSTKSNSTITLQCRIKQIINMWQGVGRAMYAPPIAGNITCKSNVTGLLLTRDGGTNSSQTEEETFRPA
GGDMRDNWRSELYKYKVVEIQPLGIAPTGAKERVVEREKEAAGLGALFLGFLGAAGSTMGAASITLTVQARQLLSGI
VQQQSNLLRAIEAQQHMLQLTVWGIKQLQARVLALERYLKDQQLLGMWGCSGKLICTTNVPWNTSWSNKSEMDIWDN
MTWMQWEREISNYTETIYKLLEDSQNQQERNEQDLLALDSWNSLWNWFNITKWLWYIK**GIX

>HV1301070, CH0848.3.D0808.15.25gp140C

MRVMGILKNYPQWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSNATVKNRTVEEMKNCSFNTTTEI
RDKEKKEYALFYRPDIVPLNENETSNTSEYRLINCNTSAVTQACPKVTFEPIPIHYCAPAGYAILKCNDETFNGTGP
CSNVSTVQCTHGIRPVVSTQLLLNGSLAEKEIVIRSENLTNNAKIIVHLNAPVEIVCTRPNNDTRKSVRIGPGQTF
YATGDIIGDIRQAHCNISEKEWNETLQKVGIELQKHFPNKTIKYEQSAGGDMEITTHSFNCGGEFFYCNTSKLFNGT
YNGTYINTSSNSTITLQCRIKQIINMWQGVGRAMYAPPIAGNITCKSDITGLLLTRDGGTNSSGKEEIFRPAGGDMR
DNWRSELYKYKVVEIQPLGIAPTGAKERVVEREKEAAGLGALFLGFLGAAGSTMGAASITLTVQARQLLSGIVQQQS
NLLRAIEAQQHMLQLTVWGIKQLQARVLALERYLKDQQLLGMWGCSGKLICTTNVPWNTSWSNKSETDIWDNMTWMQ
WEREISNYTETIYKLLEDSQNQQERNEQDLLALDSWNSLWNWFNITKWLWYIK**GIX

>HV1301071, CH0848.3.D0864.3.03gp140C

MRVMGILKNYPQWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSNTVNNRTVYEMKNCSFNTTTEIR
DKEKKEYALFYRPDIVPLNENETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVQLNTSVEIVCTRPNNNTRKSVRIGPGQTFY
ATGDIIGEIRQAHCNISEKEWNETLQKVGKELQKHFPNKTIKYAQSAGGDMEITTHSFNCGGEFFYCNTANLFNGTY
NGTDISTNSSTKSNSTITLQCRIKQIINMWQGVGRAMYAPPIAGNITCRSTITGLLLTRDGGNSSKTEEETFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSKTDIWDNMT
WMQWEREISNYTETIYKLLEDSQNQQERNEQDLLALDSWNSLWNWFNITKWLWYIK**GIX

>HV1301072, CH0848.3.D0893.10.05gp140C

MRVMGILKNYPQWWIWGILGFWMLMICNGKGKLWVTVYYGVPVWKEAKTTLFCASDAKAYEKEVHNVWATHACVPTD
PSPQELVLGNVTENFNMWKNDMVDQMHEDIISLWDQSLKPCVKLTPLCVTLICSNTVNNRTVYEMKNCSFNTTTEIR
DKEKKEYALFYRPDIVPLNENETSNTSEYRLINCNTSAVTQACPKVTFEPIPIHYCAPAGYAILKCNDETFNGTGPC
SNVSTVQCTHGIRPVVSTQLLLNGSLAEKEIVIRSENLTNNAKIIIVQLNTSVEIVCTRPNNNTRKSVRIGPGQTFY
ATGDIIGEIRQAHCNISEEEWNDTLQKVGKELQKHFPNKTIEYKQSAGGDMEITTHSFNCGGEFFYCNTAKLFNGTY
NGTDISTNSSTNSNPTITLQCRIKQIINMWQGVGRAMYAPPIAGNITCKSNITGLLLTRDGGNSSKTEEEIFRPAGG
DMRDNWRSELYKYKVVEIQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSETDIWDNMT
WMQWEREISNYTGTIYKLLEDSQNQQERNEQELLALDSWNSLWNWFNITKWLWYIK**GIX

>HV1301073, CH0848.3.D0949.10.10gp140C

MRVMGILKNYPQWWIWGILGFWMLMNCNGEGNLWVTVYYGVPVWKEAKTTLFCASDAKAYKKEVHNVWATHACVPTD
PSPQELFLDNVTENFNMWKNDMVDQMHEDIISLWDQSLKPCVKLTPLCVTLICSNATVENKTVEEMKNCSFNTTTEI
RDKEKKEYALFYKPDVVPLDETNNTSEYRLINCNTSAVTQACPKVTFEPIPIHYCAPAGYAILKCNDETFNGTGPCS
NVSTVQCTHGIRPVVSTQLLLNGSLAEKEIVIRSENLTNNAKIIVHLHTPVEIVCTRPNNNTRKSVRIGPGQTFYA
TGDIIGDIKQAHCNISEKKWNETLQKVGIELQKHFPNKTIKYNQSAGGDMEITTHSFNCGGEFFYCNTSNLFNGTYN
GTYISTNSSANSTSTITLQCRIKQIINMWQGVGRAMYAPPIAGNITCRSNITGLLLTRDGGTNSNETETFRPAGGDM
RDNWRSELYKYKVVEIQPLGIAPTGAKERVVEREKEAAGLGALFLGFLGAAGSTMGAASITLTVQARQLLSGIVQQQ
SNLLRAIEAQQHMLQLTVWGIKQLQARVLALERYLKDQQLLGMWGCSGKLICTTNVPWNTSWSNKSETDIWDNMTWM
QWEREISNYTETIYKLLEDSQNQQERNEQDLLALDSWNSLWNWFSITKWLWYIK**GIX

>HV1301074, CH0848.3.D0949.10.17gp140C

MRVMGILKNYPQWWIWGILGFWMLMICNGKGKLWVTVYYGVPVWKEAKTTLFCASDARAYEKEVHNVWATHACVPTD
PSPQELVLGNVTENFNMWKNDMVDQMHEDIISLWDQSLKPCVKLTPLCVTLICSNATVKNGTVEEMKNCSFNTTTEI
RDKEKKEYALFYKPDIVPLSETNNTSEYRLINCNTSAVTQACPKVTFEPIPIHYCAPAGYAILKCNDETFNGTGPCS
NVSTVQCTHGIRPVVSTQLLLNGSLAEKEIVIRSENLTNNAKIIVHLHTPVEIVCTRPNNNTRKSVRIGPGQTFYA

Figure 8 continued

```
TGDIIGDIKQAHCNISEEKWNDTLQKVGIELQKHFPNKTIKYNQSAGGDMEITTHSFNCGGEFFYCNTSNLFNGTYN
GTYISTNSSANSTSTITLQCRIKQIINMWQGVGRAMYAPPIAGNITCRSNITGLLLTRDGGTNSNETETFRPAGGDM
RDNWRSELYKYKVVEIQPLGIAPTGAKERVVEREKEAAGLGALFLGFLGAAGSTMGAASITLTVQARQLLSGIVQQQ
SNLLRAIEAQQHMLQLTVWGIKQLQARVLALERYLKDQQLLGMWGCSGKLICTTNVPWNTSWSNKSETDIWDNMTWM
QWEREISNYTETIYKLLEDSQNQQERNEQDLLALDSWNSLWNWFSITKWLWYIK**GIX
```

>HV1301075, CH0848.3.D0808.15.15gp140C

```
MRVMGILKNYPQWWIWGILGFWMLMICNGKGKLWVTVYYGVPVWKEAKTTLFCASDARAYEKEVHNVWATHACVPTD
PSPQELFLKNVTENFNMWKNDMVDQMHEDIISLWDQSLKPCVKLTPLCVTLICSNATVKNRTVEEMKNCSFNTTTEI
RDKEKKEYALFYKPDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPNNNTRKSVRIGPGQTFYA
TGDIIGDIRQAHCNISEKQWNDTLQKVGKELKKHFPNKTIKYAQSAGGDMEITTHSFNCGGEFFYCNTAKLFNGTYN
GTDISTNSSADSNSTITLQCRIKQIINMWQGVGRAMYAPPIAGNITCKSHITGLLLTRDGGTNSSGKEEIFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSETDIWDNMTW
MQWEREISNYTETIYKLLEDSQNQQEPNEQDLLALDSWNSLWNWFNITKWLWYIK**GIX
```

>HV1301076, CH0848.3.D0780.15.22gp140C

```
MRVMGILKNYPQWWIWGILGFWMLMICNGKGKLWVTVYYGVPVWKEAKTTLFCASDARAYEKEVHNVWATHACVPTD
PNPQELVLGNVTENFNMWKNDMVDQMHEDIISLWDQSLKPCVKLTPLCVTLICSNATVKNRTVEEMKNCSFNTTTEI
RDKEKKEYALFYKPDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPNNNTRKSVRIGPGQTFYA
TGDIIGDIRQAHCNISEKQWNDTLQKVGKELKKHFPNKTIKYAQSAGGDMEITTHSFNCGGEFFYCNTAKLFNGTYN
GTDISTNSSADSNSTITLQCRIKQIINMWQGVGRAMYAPPIAGNITCKSHITGLLLTRDGGTNSSEKEEIFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSEKDIWDNMTW
MQWEREISNYTETIYKLLEDSQNQQERNEKDLLALDSWNSLWNWFNITKWLWYIK**GIX
```

>HV1301077, CH0848.3.D0780.15.29gp140C

```
MRVMGIPKNYPQWWIWGILGFWMLMICNGKGKLWVTVYYGVPVWKEAKTTLFCASDAKAYKKEVHNVWATHACVPTD
PNPQELVLGNVTENFNMWKNDMVDQMHEDIISLWDQSLKPCVKLTPLCVTLICSNATVKNRTVEEMKNCSFNTTTEI
RDKEKKEYALFYKPDVVPLDETNNTSEYRLINCNTSAVTQACPKVTFEPIPIHYCAPAGYAILKCNNETFNGTGPCS
NVSTVQCTHGIRPVVSTQLLLNGSLAEKEIVIRSENLTNNAKIIIVHLNTPVEIVCTRPNNNTRKSVRIGPGQTFYA
TGDIIGDIRQAHCNISEKQWNDTLQKVGKELKKHFPNKTIKYAQSAGGDMEITTHSFNCGGEFFYCNTAKLFNGTYN
GTDISTNSSADSNSTITLQCRIKQIINMWQGVGRAMYAPPIAGNITCKSHITGLLLTRDGGTNSSEKEEIFRPAGGD
MPDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSEKDIWDNMTW
MQWEREISNYTETIYKLLEDSQNQQERNEKDLLALDSWNSLWNWFNITKWLWYIK**GIX
```

>HV1301078, CH0848.3.D0808.15.43gp140C

```
MRVMGILKNYPQWWIWGILGFWMLMICNGKGKLWVTVYYGVPVWKEAKTTLFCASDAKAYKKEVHNVWATHACVPTD
PSPQELFLKNVTENLNMWKNDMVDQMHEDIISLWDQSLKPCVKLTPLCVTLICSNATVKNRTVEEMKNCSFNTTTEI
RDKEKKEYALFYRPDIVPLNENETSNTSEYRLINCNTSAVTQACPKVTFEPIPIHYCAPAGYAILKCNNETFNGTGP
CSNVSTVQCTHGIRPVVSTQLLLNGSLAEKEIVIRSENLTNNAKIIIVHLNTPVEIVCTRPNNNTRKSVRIGPGQTF
YATGDIIGDIRQAHCNISEKQWNDTLQKVGKELQKHFPNKTIKYKHSAGGDMEITTHSFNCGGEFFYCNTSNLFNGT
YNGTYMNISTDSNSTITLQCRIKQIINMWQGVGRAMYAPPIAGNITCKSHITGLLLTRDGGTNSSGKEEIFRPAGGD
MRDNWRSELYKYKVVEIQPLGIAPTGAKERVVEREKEAAGLGALFLGFLGAAGSTMGAASITLTVQARQLLSGIVQQ
QSNLLRAIEAQQHMLQLTVWGIKQLQARVLALERYLKDQQLLGMWGCSGKLICTTNVPWNTSWSNKSETDIWDNMTW
MQWEREISNYTETIYKLLEDSQNQQERNEQDLLALDSWNSLWNWFNITKWLWYIK**GIX
```

>HV1301079, CH0848.3.D1120.10.05gp140C

```
MRVMGIPKNYPQWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSTATVNKSTVEEMKNCSFNTTTEI
RDKEKKEYALFYRPDIVPLNNKTSNTSEYRLINCNTSAVTQACPKVTFEPIPIHYCAPAGYAILKCNDETFNGTGPC
```

Figure 8 continued

```
SNVSTVQCTHGIRPVVSTQLLLNGSLAEEEIVIRSENLTNNAKIIIVHLHTPVEIVCTRPNNNTRKSVRIGPGQTFY
ATGGIIGDVRQAHCNISKGLWNDTLQKVGKELQKHFPNKTIRYNQSAGGDMEITTHSFNCGGEFFYCNTAKLFNGTY
NGTDISTNSSANNSSTITLQCRIKQIINMWQGVGRAMYAPPIAGNITCKSNITGLLLTRDGGINSSREEEIFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGMWGCSGKLICTTNVPWNTSWSNKSEMDIWDNMT
WMQWEREISNYTETIYKLLEDSQNQQERNEQDLLALDSWNSLWNWFNITKWLWYIK**GIX
```

>HV1301080, CH0848.3.D1432.5.06gp140C

```
MRVMGIPKNYPRWWIWGILGFWMLMICNGKGKLWVTVYYGVPVWKEAKTTLFCASDAKAYVKEVHNVWATHACVPTD
PSPQELLLKNVTENFNMWKNDMVDQMHEDIISLWDQSLKPCVKLTPLCVTLICSNATVENSTTDEMKNCSFNTTTEI
RDKEKKERALFYRPDIVPLNNETGNTSEYRLINCNTSAITQACPKVTFEPIPIHYCAPAGYAILKCNDETFNGTGPC
SSVSTVQCTHGIRPVVSTQLLLNGSLAEKGIVIRSENLTNNAKIIIVHLNASVEIVCTRPNNNTRKSVRIGPGQTFY
ATGDIIGDIRQAHCNISEKKWNETLQKVGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSNITGLLLTRDGGIHNDSNETETFRPAGG
DMPDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGIWGCSGKLICTTNVPWNTSWSNKSETDIWGNMT
WMQWEREISNYTETIYKLLEDSQNQQERNEQDLLALDSWNSLWSWFNITKWLWYIK**GIX
```

>HV1301081, CH0848.3.D1432.5.48gp140C

```
MRVMGIPKNYPRWWIWGILGFWMLMICNGKGKLWVTVYYGVPVWKEAKTTLFCASDAKAYVKEVHNVWATHACVPTD
PSPQELLLKNVTENFNMWKNDMVDQMHEDIISLWDQSLKPCVKLTPLCVTLICSNATVENSTTDEMKNCSFNTTTEI
RDKEKKERALFYRPDIVPLNNETGNTSEYRLINCNTSAITQACPKVTFEPIPIHYCAPAGYAILKCNDETFNGTGPC
SSVSTVQCTHGIRPVVSTQLLLNGSLAEKGIVIRSENLTNNAKIIIVHLNASVEIVCTRPNNNTRKSVRIGPGQTFY
ATGDIIGDIRQAHCNISEKKWNETLQKVGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSNITGLLLTRDGGIHNDSNETETFRPAGG
DMRDNWRSELYKYKVVEIQPLGIAPTGAKEPVVEREKEAAGLGALFLGFLGAAGSTMGAASITLTVQARQLLSGIVQ
QQSNLLRAIEAQQHMLQLTVWGIKQLQARVLALERYLKDQQLLGIWGCSGKLICTTNVPWNTSWSNKSETDIWENMT
WMQWEREISNYTETIYKLLEDSQNQQERNEQDLLALDSWNSLWSWFNITKWLWYIK**GIX
```

>HV1301082, CH0848.3.D1432.5.35gp140C

```
MRVMGIPKNYPRWWIWGILGFWMLMICNGKGKLWVTVYYGVPVWKEAKTTLFCASDAKAYVKEVHNIWATHACVPTD
PSPQELLLKNVTENFNMWKNDMVDQMHEDIISLWDQSLKPCVKLTPLCVTLICSNATVQSTTEEMKNCSFNTTTEI
RDKEKKEHALFYRPDIVPLDNETGNTSEYRLINCNTSAVTQACPKVTFEPIPIHYCAPAGYAILKCNDETFNGTGPC
SKVSTVQCTHGIRPVVSTQLLLNGSLAEKGIVVRSENLTNNAKIIIVQLNASVEIVCTRPNNNTRKSVRIGPGQTFY
ATGDIIGNIRQAHCNISEKKWNETLQKVGIELQKHFPNKTIKYNQSAGGDMEITTHSFNCGGEFFYCNTAKLFNSTY
NGTYISTNSINSTLNITLQCRIKQIINMWQGVGRAMYAPPIAGNITCRSNITGLLLTRDGGIHNDSNETETFRPAGG
DMRDNWRSELYKYKVVEVQPLGIAPTGAKERVVEREKEAAGLGALFLGFLGAAGSTMGAASITLTVQARQLLSGIVQ
QQSNLLRAIEAQQHMLQLTVWGIKQLQARVLALERYLKDQQLLGIWGCSGKLICTTNVPWNTSWSNKSETDIWENMT
WMQWEREISNYTETIYKLLEDSQNQQERNEQDLLALDSWNSLWSWFNITKWLWYIK**GIX
```

>HV1301083, CH0848.3.D1651.10.07gp140C

```
MRVMGIPKNYPLWWIWGILGFWMLMNCNGEGNLWVTVYYGVPVWKEAKTTLFCASDAKAYVKEVHNVWATHACVPTD
PSPQELVLDNVTENFNMWKNDMVDQMHEDIISLWDQSLKPCVKLTPLCVTLNCSNAIVKNSTTEEISHALARNSTTE
EMKNCSFNTTTEIRDKEKKEYALFYRPDIVPLNNKTSNISEYRLINCNTSTVTQACPKVTFEPIPIHYCAPAGYAIL
KCNDETFNGTGPCSNVSTVQCTHGIRPVVSTQLLLNGSLAEKGIVIRSENLTNNAKIIIVQLNANASVEIVCTRPNN
NTRKSVRIGPGQTFYATGDIIGNIRQAHCNISEKKWNETLQKVGIELQKHFPNKTIKYNQSAGGDMEITTHSFNCGG
EFFYCNTAKLFNSTYNGTYISTNSINSTLNITLQCRIKQIINMWQGVGRAMYAPPIAGNITCRSNITGLLLTRDGGI
HNDSNVTETFRPAGGDMRDNWRSELYKYKVVEIQPLGIAPTGAKERVVERGKEAAGLGALFLGFLGAAGSTMGAASI
TLTVQARQLLSGIVQQQSNLLRAIEAQQHMLQLTVWGIKQLQARVLALERYLKDQQLLGIWGCSGKLICTTNVPWNT
SWSNKSEMDIWNNMTWMQWEREISNYTGTIYKLLEDSQNQQERNEQDLLALDSWNSLWNWFDITKWLWYIK**GIX
```

>HV1301084, CH0848.3.D1432.5.26gp140C

```
MRVMGILKNYPQWWIWGILGFWMLMNCNGEGNLWVTVYYGVPVWKEAKTTLFCASDAKAYKKEVHNVWATHACVPTD
PSPQELFLKNVTENFNMWKNDMVDQMHEDIISLWDQSLKPCVKLTPLCVTLICSNAIVKNSTTEEMSNATVKNSTTE
```

Figure 8 continued

```
EMKNCSFNTTTEIRDKEKKEYALFYRPDVVPLDETNNTSKYRLINCNTSAVTQACPKVTFEPIPIHYCAPAGYAILK
CNDETFNGTGPCSNVSTVQCTHGIRPVVSTQLLLNGSLAEKEIVIRSENLTNNAKTIIVHLHTPVEIVCTRPYNNTR
KSVRIGPGQTFYATGDIIGDPRQAHCNISKETWNKTLQEVGKELQKHFPNKTIRYNQSAGGDMEITTHSFNCGGEFF
YCNTSNLFNSTYNDTYISPNSTNSTSTITLQCRIKQIINMWQGVGRAMYAPPIAGNITCKSNITGLLLTRDGGTTNN
SNETETFRPAGGDMRDNWRSELYKYKVVEVQPLGLAPTGAKERVVEREKEAAGLGALFLGFLGAAGSTMGAASITLT
VQARQLLSGIVQQQSNLLRAIEAQQHMLQLTVWGIKQLQARVLALERYLKDQQLLGIWGCSGKLICTTNVPWNTSWS
NKSEMDIWGNMTWMQWEREISNYTGTIYKLLEDSQNQQERNEQDLLALDSWNNLWNWFSITKWLWYIK**GIX
```

FIGURE 9

| ~Years (Days) Post Infection | Clade B | | | | | | Clade C | | | | | | Clade A | | | | SVA-MLV |
|---|---|---|---|---|---|---|---|---|---|---|---|---|---|---|---|---|---|
| | 6535 | QH0692 | SC422661 | PV0.4 | AC10 | RHPA4259 | Du156 | Du172 | Du422 | ZM197M | ZM214M | CAP45 | Q23 | Q842 | Q259 | Q769 | |
| 1 (358) | 10 | 10 | 10 | 10 | 10 | 10 | 10 | 31 | 10 | 10 | 10 | 10 | 10 | 10 | 10 | 10 | 10 |
| 2 (700) | 10 | 10 | 10 | 10 | 10 | 10 | 10 | 81 | 10 | 10 | 10 | 10 | 10 | 10 | 10 | 10 | 10 |
| 2.5 (949) | 10 | 10 | 38 | 10 | 10 | 10 | 10 | 61 | 10 | 10 | 10 | 10 | 64 | 10 | 10 | 10 | 10 |
| 3 (1120) | 115 | 10 | 92 | 10 | 10 | 10 | 25 | 101 | 10 | 43 | 10 | 10 | 10 | 50 | 10 | 10 | 10 |
| 3.5 (1305) | 460 | 56 | 207 | 32 | 21 | 59 | 280 | 83 | 152 | 105 | 10 | 10 | 37 | 74 | 10 | 10 | 10 |
| 4 (1432) | 1363 | 100 | 207 | 251 | 209 | 250 | 682 | 415 | 341 | 105 | 37 | 10 | 1483 | 54 | 112 | 10 | 10 |

COMPOSITIONS COMPRISING CH848 ENVELOPES AND USES THEREOF

This application is a U.S. National Stage application under 35 U.S.C. § 371 of International Patent Application No. PCT/US15/23632, filed Mar. 31, 2015, which claims the benefit of and priority of U.S. Application Ser. No. 61/972,649, filed Mar. 31, 2014, the contents of which application are herein incorporated by reference in their entireties.

The instant application contains a Sequence Listing which has been submitted electronically in ASCII format and is hereby incorporated by reference in its entirety. Said ASCII copy, created on Jun. 15, 2017, is named 2017-06-19 239 US1 App No. 15300051 Sequence Listing and is 3,082,557 bytes in size This invention was made with government support under Center for HIV/AIDS Vaccine Immunology-Immunogen Design grant UM1-A1100645 from the NIH, NIAID, Division of AIDS. The government has certain rights in the invention.

FIELD OF THE INVENTION

The present invention relates in general, to a composition suitable for use in inducing anti-HIV-1 antibodies, and, in particular, to immunogenic compositions comprising envelope proteins and nucleic acids to induce cross-reactive neutralizing antibodies and increase their breadth of coverage. The invention also relates to methods of inducing such broadly neutralizing anti-HIV-1 antibodies using such compositions.

BACKGROUND

The development of a safe and effective HIV-1 vaccine is one of the highest priorities of the scientific community working on the HIV-1 epidemic. While anti-retroviral treatment (ART) has dramatically prolonged the lives of HIV-1 infected patients, ART is not routinely available in developing countries.

SUMMARY OF THE INVENTION

The present invention is directed to HIV-1 immunogens and uses thereof. In certain aspects the invention provides immunogenic compositions comprising HIV-1 envelopes and their uses in methods to induce immune response. In certain aspects, the immune responses induced are broadly neutralizing antibodies.

In certain embodiments, the invention provides compositions and method for induction of immune response, for example cross-reactive (broadly) neutralizing Ab induction. In certain embodiments, the methods use compositions comprising "swarms" of sequentially evolved envelope viruses that occur in the setting of bnAb generation in vivo in HIV-1 infection.

In certain aspects the invention provides compositions comprising a selection of HIV-1 envelopes, or nucleic acids encoding these envelopes, or a combination thereof as described herein for example but not limited to selections as described herein. In certain embodiments, these envelopes are used in immunization methods as a prime and/or boost(s).

In one aspect the invention provides a composition comprising nucleic acids encoding HIV-1 envelopes as described herein. In certain embodiments, the compositions contemplate nucleic acid, as DNA and/or RNA, or proteins immunogens either alone or in any combination. In certain embodiments, the methods contemplate genetic, as DNA and/or RNA, immunization either with nucleic acids alone or in combination with envelope protein(s). In certain embodiments, the nucleic acids and the protein are directed to the same envelope variant, as a non-limiting example gp120. In other embodiments, the nucleic acids encode one variant, as a non-limiting example gp160 or gp145, while the corresponding envelope protein is another variant, as a non-limiting example gp120, or gp140.

In certain embodiments the nucleic acid encoding an envelope is operably linked to a promoter inserted an expression vector. In certain aspects the compositions comprise a suitable carrier. In certain aspects the compositions comprise a suitable adjuvant.

In certain embodiments the induced immune response includes induction of antibodies, including but not limited to autologous and/or cross-reactive (broadly) neutralizing antibodies against HIV-1 envelope. Various assays that analyze whether an immunogenic composition induces an immune response, and the type of antibodies induced are known in the art and are also described herein.

In certain aspects the invention provides an expression vector comprising any of the nucleic acid sequences of the invention, wherein the nucleic acid is operably linked to a promoter. In certain aspects the invention provides an expression vector comprising a nucleic acid sequence encoding any of the polypeptides of the invention, wherein the nucleic acid is operably linked to a promoter. In certain embodiments, the nucleic acids are codon optimized for expression in a mammalian cell, in vivo or in vitro. In certain aspects the invention provides nucleic acid comprising any one of the nucleic acid sequences of invention. A nucleic acid consisting essentially of any one of the nucleic acid sequences of invention. A nucleic acid consisting of any one of the nucleic acid sequences of invention. In certain embodiments the nucleic acid of invention, is operably linked to a promoter and is inserted in an expression vector. In certain aspects the invention provides an immunogenic composition comprising the expression vector.

In certain aspects the invention provides a composition comprising at least one of the nucleic acid sequences of the invention. In certain aspects the invention provides a composition comprising any one of the nucleic acid sequences of invention. In certain aspects the invention provides a composition comprising at least one nucleic acid sequence encoding any one of the polypeptides of the invention.

In certain embodiments, the compositions and methods employ an HIV-1 envelope as polypeptide instead of a nucleic acid sequence encoding the HIV-1 envelope. In certain embodiments, the compositions and methods employ an HIV-1 envelope as polypeptide, a nucleic acid sequence encoding the HIV-1 envelope, or a combination thereof. The envelope can be a gp160, gp150, gp145, gp140, gp120, gp41, N-terminal deletion variants as described herein, cleavage resistant variants as described herein, or codon optimized sequences thereof. The polypeptide contemplated by the invention can be a polypeptide comprising any one of the polypeptides described herein. The polypeptide contemplated by the invention can be a polypeptide consisting essentially of any one of the polypeptides described herein. The polypeptide contemplated by the invention can be a polypeptide consisting of any one of the polypeptides described herein. In certain embodiments, the polypeptide is recombinantly produced. In certain embodiments, the polypeptides and nucleic acids of the invention are suitable for use as an immunogen, for example to be administered in a human subject.

In certain aspects the invention provides a composition comprising a nucleic acid encoding HIV-1 envelope as described herein or any combination thereof, e.g. FIG. 1 or any combination thereof, or FIG. 2 or any combination thereof, or FIG. 6 or any combination thereof, or FIG. 8 or any combination thereof, or any suitable variants such as gp160, gp150, gp145, gp140, gp120, gp41, N-terminal deletion variants as described herein, cleavage resistant variants as described herein, or codon optimized sequences thereof.

In certain embodiments, the nucleic acid encoding the CH848 envelope encodes a gp160 envelope. In certain embodiments, the nucleic acid encoding the CH848 envelope encodes a gp140 envelope. In certain embodiments, the nucleic acid encoding the CH848 envelope encodes a gp120 or D11gp120 envelope.

In certain aspects the invention provides a composition comprising any one of the polypeptides of FIG. 1 or any combination thereof, or FIG. 2 or any combination thereof, or FIG. 6 or any combination thereof, or FIG. 8 or any combination thereof, or any suitable variants such as gp160, gp150, gp145, gp140, gp120, gp41, N-terminal deletion variants as described herein, cleavage resistant variants as described herein, or codon optimized sequences thereof.

In certain embodiments, the polypeptide is a gp160 envelope. In certain embodiments, the polypeptide is a gp140 envelope. In certain embodiments, the polypeptide is a gp120 envelope. In certain embodiments, the polypeptide is recombinantly expressed.

In certain embodiments, the nucleic acid is operably linked to a promoter inserted in an expression vector.

In certain aspects, the invention provides an immunogenic composition comprises any one of the envelopes described herein and further comprising an adjuvant.

In certain aspects, the invention provides a method of inducing an immune response in a subject comprising administering a composition comprising a suitable HIV-1 envelope from CH848, e.g. CH84 T/F, as a prime in an amount sufficient to induce an immune response. In certain embodiments, the envelope is administered as gp160. In other embodiments, the envelope is administered as gp120. In other embodiments, the envelope is administered as any suitable variant, e.g. gp160, gp150, gp145, gp140, gp120, gp41, N-terminal deletion variants as described herein, cleavage resistant variants as described herein, or codon optimized sequences thereof. In certain embodiments, the envelope is administered as a nucleic acid, a protein, or a combination thereof.

In certain embodiments, the method further comprises administering a composition comprising any one of the CH848 envelopes described herein, or any combination thereof, for example, the envelope is administered as any suitable variant, e.g. gp160, gp150, gp145, gp140, gp120, gp41, N-terminal deletion variants as described herein, cleavage resistant variants as described herein, or codon optimized sequences thereof. In certain embodiments, the envelope or combinations thereof are administered as nucleic acids, protein, or a combination thereof.

In certain embodiments of the methods, the envelope is administered as a protein or a nucleic acid encoding the envelope, or any combination thereof. In certain embodiments of the methods, the protein is recombinant. In certain embodiments of the methods, the nucleic acid encoding the envelope is operably linked to a promoter inserted in an expression vector.

BRIEF DESCRIPTION OF THE DRAWINGS

FIG. 1 shows amino acids encoding gp160s envelopes from CH848 (SEQ ID NOs: 2 through 101 in order of appearance). d0135.27.03 represents the T/F form.

FIG. 2 shows amino acid sequence of gp120 envelopes from CH848. d0135.27.03 represents the T/F form. (SEQ ID NOs: 102 through 201 in order of appearance).

FIG. 3 shows one embodiment of optimized nucleic acid sequences encoding the gp160s of FIG. 2. (SEQ ID NOs: 202 through 278 in order of appearance). Coding sequence is in capital letters.

FIG. 4 shows CH848 TF gp160 wild-type DNA and a.a sequences, examples of gp140C and delta 11 deletion gp120 design. Coding sequence is in capital letters. Sequences are identified by the sequence identifiers listed in the Figure.

FIG. 5 shows DNA sequence of CH848D11gp120 constructs. (SEQ ID NOs: 287 through 386 in order of appearance). Coding sequence starts with the first ATG in capital letters.

FIG. 6 shows amino acid sequence of CH848D11gp120 constructs. (Coding sequence ends with **; SEQ ID NOs: 387 through 558 in order of appearance).

FIG. 7 shows DNA sequence of CH848gp140C constructs. (SEQ ID NOs: 559 through 658 in order of appearance). Coding sequence starts with the first ATG in capital letters.

FIG. 8 shows amino acids sequences of CH848gp140C constructs. (Coding sequence ends with **; SEQ ID NOs: 659 through 830 in order of appearance).

FIG. 9 shows that CH0848 Exhibits Broad Heterologous Neutralization. CH0848 was infected by a single, Clade C T/F virus.

DETAILED DESCRIPTION

Figure 10:
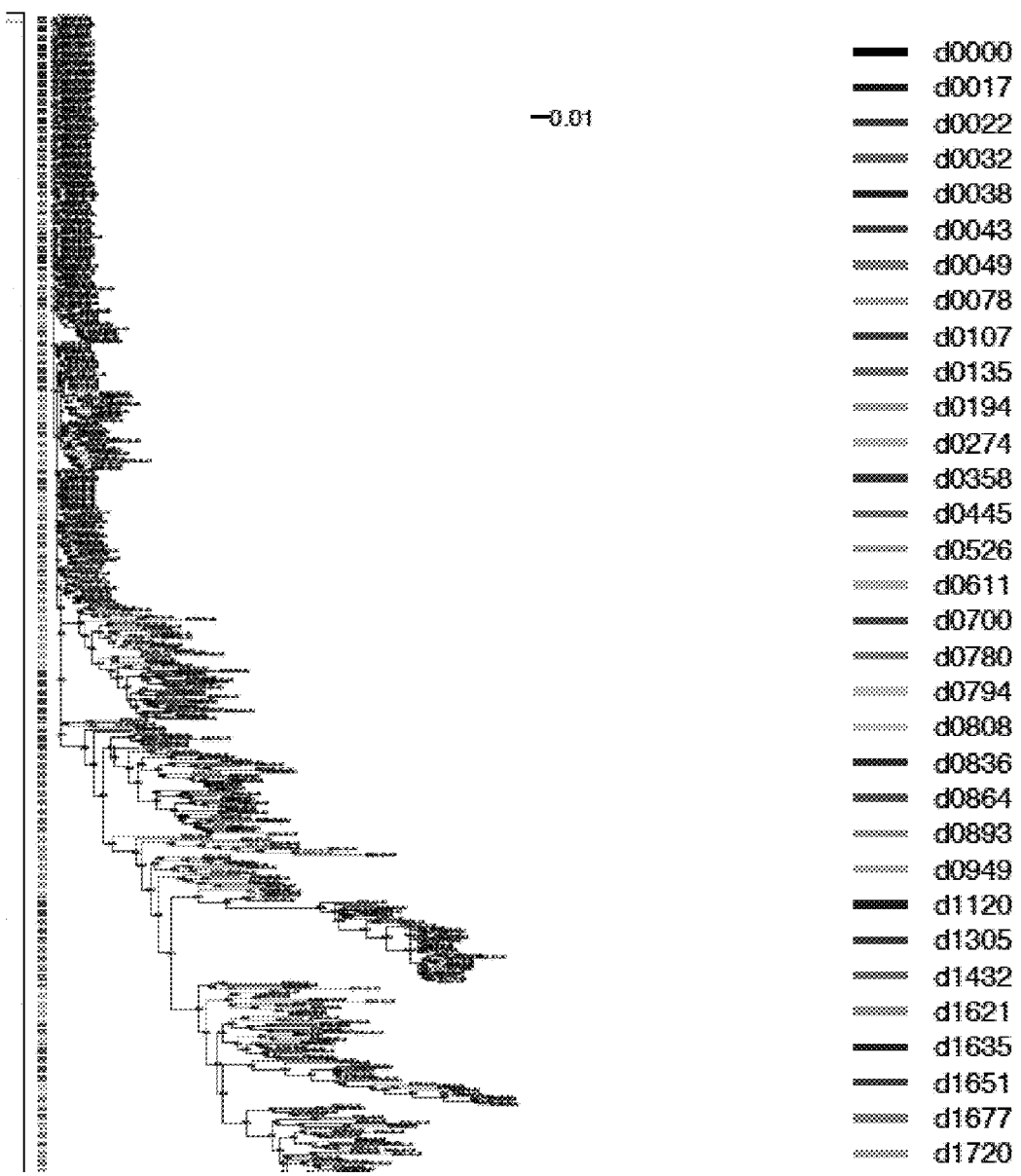
FIG. 10 shows phylogeny of 1,223 Env single genome sequences (SGSs) from CH0848 Generated over 5 Years of Infection (this pixel and tree figure is Env only, all sequences identical to TF are omitted (~200)).
Figure 10:
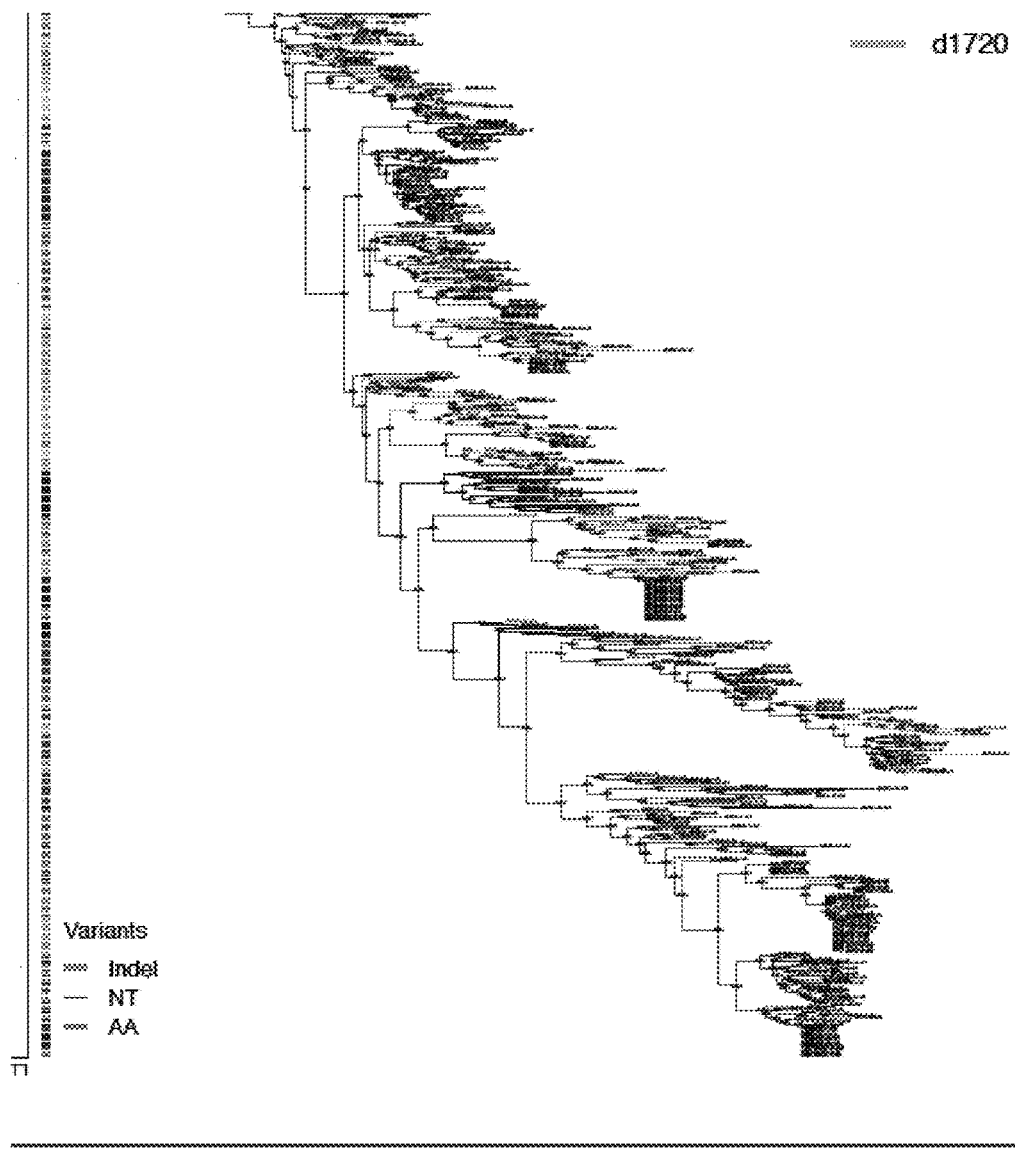
Figure 11:
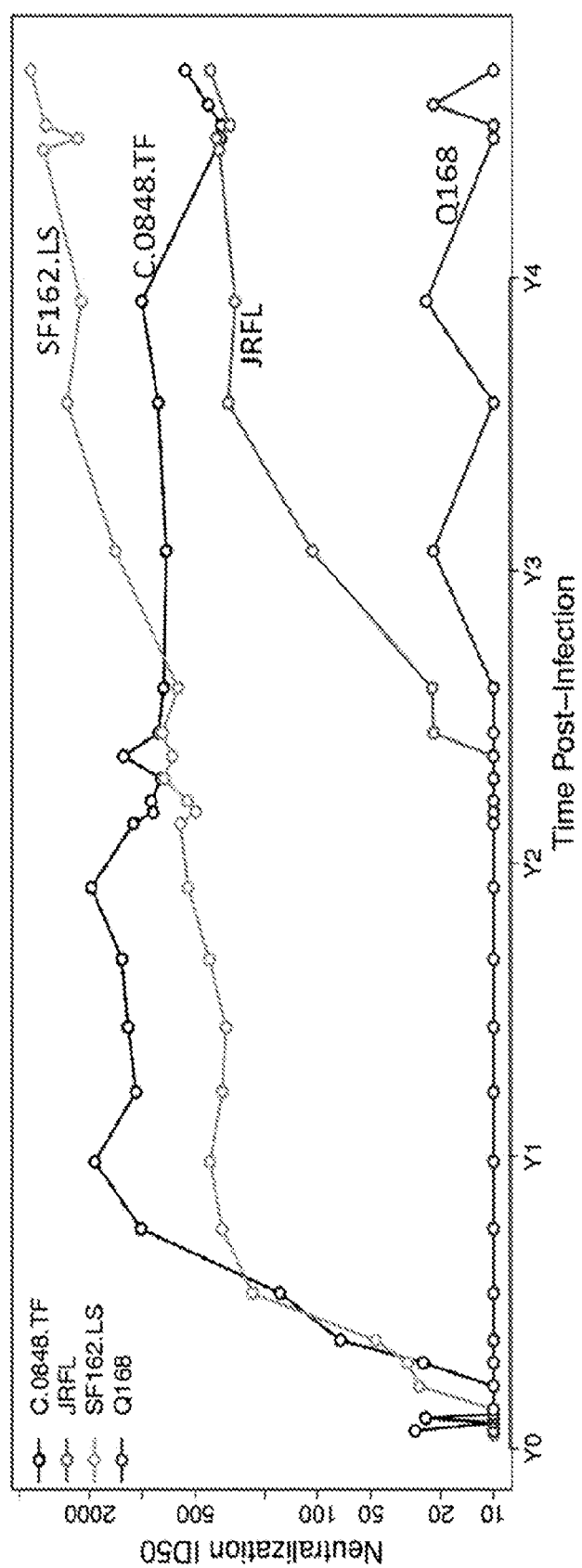
FIG. 11 shows Autologous and Heterologous Plasma Neutralization in CH0848
Figure 12A:
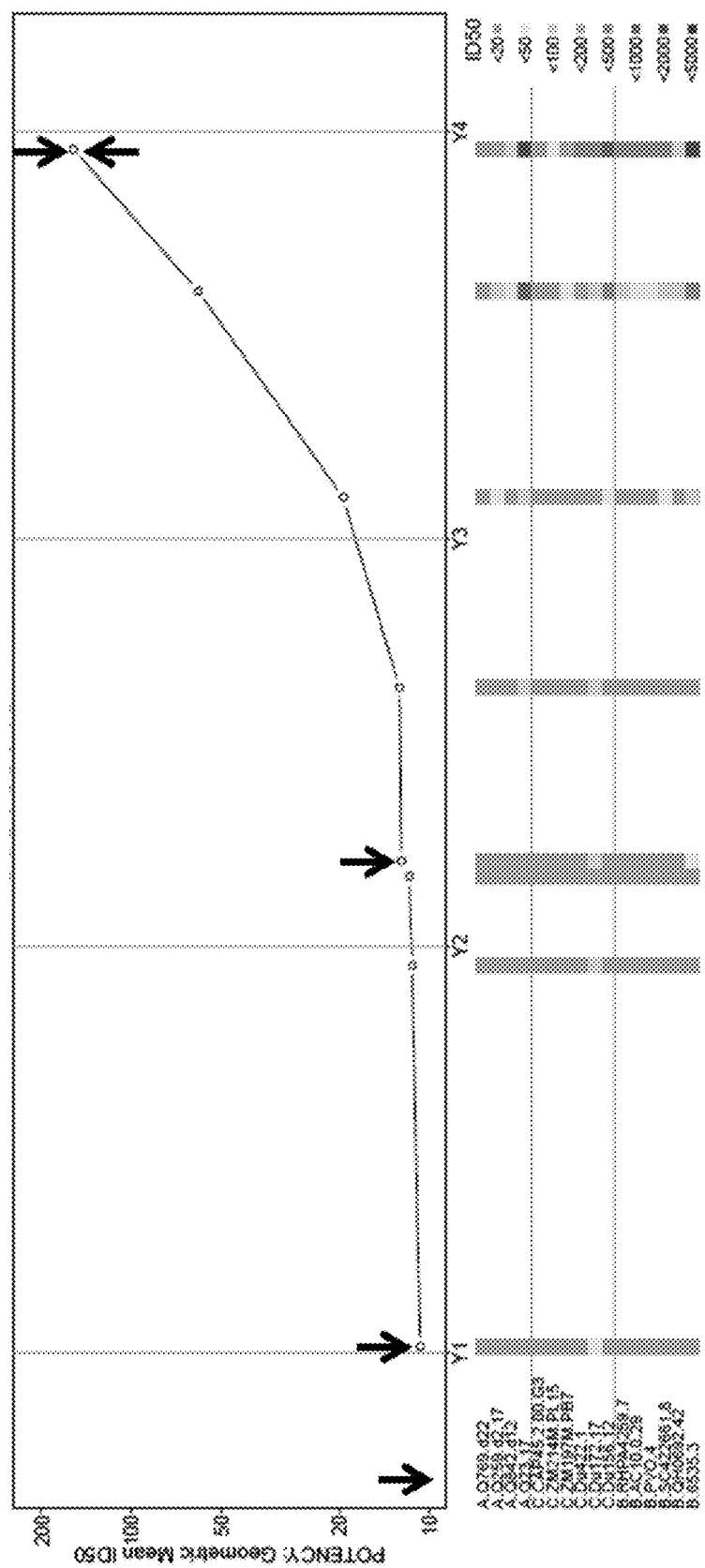
FIGS. 12A and 12B show time points for memory B-culture (upward arrow; to isolate antibodies) and sequencing (downward arrow; could be antibody and virus sequencing).
Figure 12B:
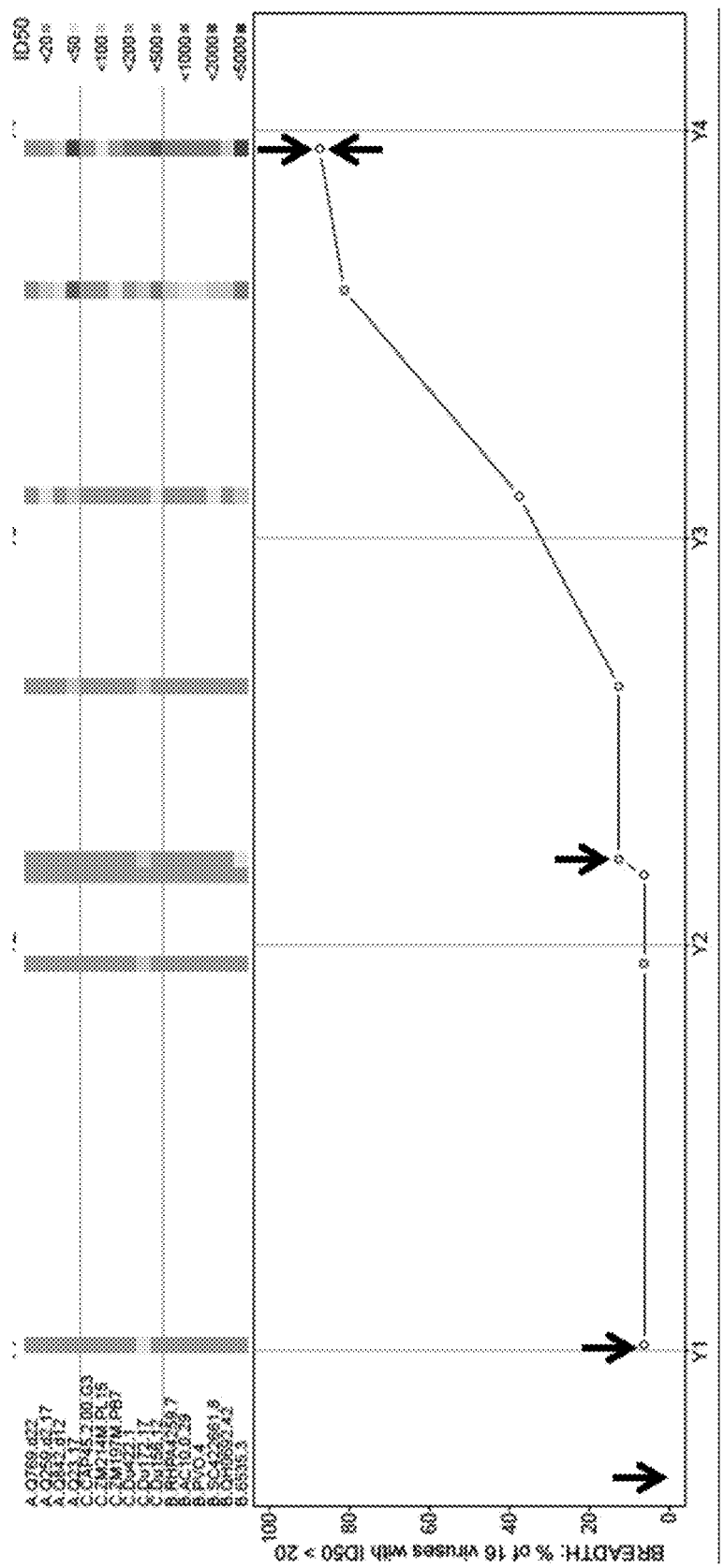

The development of a safe, highly efficacious prophylactic HIV-1 vaccine is of paramount importance for the control and prevention of HIV-1 infection. A major goal of HIV-1 vaccine development is the induction of broadly neutralizing antibodies (bnAbs) (Immunol. Rev. 254: 225-244, 2013). BnAbs are protective in rhesus macaques against SHIV challenge, but as yet, are not induced by current vaccines.

For the past 25 years, the HIV vaccine development field has used single or prime boost heterologous Envs as immunogens, but to date has not found a regimen to induce high levels of bnAbs.

Recently, a new paradigm for design of strategies for induction of broadly neutralizing antibodies was introduced, that of B cell lineage immunogen design (Nature Biotech. 30: 423, 2012) in which the induction of bnAb lineages is recreated. It was recently demonstrated the power of mapping the co-evolution of bnAbs and founder virus for elucidating the Env evolution pathways that lead to bnAb induction (Nature 496: 469, 2013). From this type of work has come the hypothesis that bnAb induction will require a selection of antigens to recreate the "swarms" of sequentially evolved viruses that occur in the setting of bnAb generation in vivo in HIV infection (Nature 496: 469, 2013).

Induction of HIV-1 envelope (Env) broadly neutralizing antibodies (BnAbs) is a key goal of HIV-1 vaccine development. BnAbs can target conserved regions that include conformational glycans, the gp41 membrane proximal region, the V1/V2 region, glycans-associated C3/V3 on gp120, and the CD4 binding site (CD4bs) (Walker et al, Science 326:285-289 (2009), Walker et al, Nature 477:466-470 (2011), Burton et al, Science 337:183-186 (2012), Kwong and Mascola, Immunity 37:412-425 (2012), Wu et al, Science 329:856-861 (2010), Wu et al, Science 333:1593-1602 (2011), Zhou et al, Science 329:811-817 (2010), Sattentau and McMichael, F1000 Biol. Rep. 2:60 (2010), Stamatotos, Curr. Opin. Immunol. 24:316-323 (2012)). Most mature BnAbs have one or more unusual features (long heavy chain third complementarity determining regions [HCDR3s], polyreactivity for non-HIV-1 antigens, and high levels of somatic mutation) suggesting substantial barriers to their elicitation (Kwong and Mascola, Immunity 37:412-425 (2012), Haynes et al, Science 308:1906-1908 (2005), Haynes et al, Nat. Biotechnol. 30:423-433 (2012), Mouquet and Nussenzweig, Cell Mol. Life Sci. 69:1435-1445 (2012), Scheid et al, Nature 458:636-640 (2009)). In particular, CD4bs BnAbs have extremely high levels of somatic mutation suggesting complex or prolonged maturation pathways (Kwong and Mascola, Immunity 37:412-425 (2012), Wu et al, Science 329:856-861 (2010), Wu et al, Science 333:1593-1602 (2011), Zhou et al, Science 329:811-817 (2010)). Moreover, it has been difficult to find Envs that bind with high affinity to BnAb germline or unmutated common ancestors (UCAs), a trait that would be desirable for candidate immunogens for induction of BnAbs (Zhou et al, Science 329:811-817 (2010), Chen et al, AIDS Res. Human Retrovirol. 23:11 (2008), Dimitrol, MAbs 2:347-356 (2010), Ma et al, PLoS Pathog. 7:e1002200 (2001), Pancera et al, J. Virol. 84:8098-8110 (2010), Xiao et al, Biochem. Biophys. Res. Commun. 390:404-409 (2009)). Whereas it has been found that Envs bind to UCAs of BnAbs targeting gp41 membrane proximal region (Ma et al, PLoS Pathog. 7:e1002200 (2001), Alam et al, J. Virol. 85:11725-11731 (2011)), and to UCAs of some V1/V2 BnAb (Bonsignori et al, J. Virol. 85:9998-10009 (2011)), to date, heterologous Envs have not been identified that bind the UCAs of CD4bs BnAb lineages (Zhou et al, Science 329:811-817 (2010), Xiao et al, Biochem. Biophys. Res. Commun. 390:404-409 (2009), Mouquet et al, Nature 467:591-595 (2010), Scheid et al, Science 333:1633-1637 (2011), Hoot et al, PLoS Pathog. 9:e1003106 (2013)), although Envs that bind CD4bs BnAb UCAs should exist (Hoot et al, PLoS Pathog. 9:e1003106 (2013)).

Eighty percent of heterosexual HIV-1 infections are established by one transmitted/founder (T/F) virus (Keele et al, Proc. Natl. Acad. Sci. USA 105:7552-7557 (2008)). The initial neutralizing antibody response to this virus arises approximately 3 months after transmission and is strain-specific (Richman et al, Proc. Natl. Acad. Sci. USA 100:4144-4149 (2003), Corti et al, PLoS One 5:e8805 (2010)). This antibody response to the T/F virus drives viral escape, such that virus mutants become resistant to neutralization by autologous plasma (Richman et al, Proc. Natl. Acad. Sci. USA 100:4144-4149 (2003), Corti et al, PLoS One 5:e8805 (2010)). This antibody-virus race leads to poor or restricted specificities of neutralizing antibodies in ~80% of patients; however in ~20% of patients, evolved variants of the T/F virus induce antibodies with considerable neutralization breadth, e.g. BnAbs (Walker et al, Nature 477:466-470 (2011), Bonsignori et al, J. Virol. 85:9998-10009 (2011), Corti et al, PLos One 5:e8805 (2010), Gray et al, J. Virol. 85:4828-4840 (2011), Klein et al, J. Exp. Med. 209:1469-1479 (2012), Lynch et al, J. Virol. 86:7588-7595 (2012), Moore et al, Curr. Opin. HIV AIDS 4:358-363 (2009), Moore et al, J. Virol. 85:3128-3141 (2011), Tomaras et al, J. Virol. 85:11502-11519 (2011)).

There are a number of potential molecular routes by which antibodies to HIV-1 may evolve and, indeed, types of antibodies with different neutralizing specificities may follow different routes (Wu et al, Science 333:1593-1602 (2011), Haynes et al, Nat. Biotechnol. 30:423-433 (2012), Dimitrol, MAbs 2:347-356 (2010), Liao et al, J. Exp. Med. 208:2237-2249 (2011)). Because the initial autologous neutralizing antibody response is specific for the T/F virus (Moore et al, Curr. Opin. HIV AIDS 4:358-363 (2009)), some T/F Envs might be predisposed to binding the germline or unmutated common ancestor (UCA) of the observed BnAb in those rare patients that make BnAbs. Thus, although neutralizing breadth generally is not observed until chronic infection, a precise understanding of the interplay between virus evolution and maturing BnAb lineages in early infection may provide insight into events that ultimately lead to BnAb development. BnAbs studied to date have only been isolated from individuals who were sampled during chronic infection (Walker et al, Science 326:285-289 (2009), Burton et al, Science 337:183-186 (2012), Kwong and Mascola, Immunity 37:412-425 (2012), Wu et al, Science 329:856-861 (2010), Wu et al, Science 333:1593-1602 (2011), Zhou et al, Science 329:811-817 (2010), Bonsignori et al, J. Virol. 85:9998-10009 (2011), Corti et al, PLoS One 5:e8805 (2010), Klein et al, J. Exp. Med. 209:1469-1479 (2012)). Thus, the evolutionary trajectories of virus and antibody from the time of virus transmission through the development of broad neutralization remain unknown.

Vaccine strategies have been proposed that begin by targeting unmutated common ancestors (UCAs), the putative naïve B cell receptors of BnAbs, with relevant Env immunogens to trigger antibody lineages with potential ultimately to develop breadth (Wu et al, Science 333:1593-1602 (2011), Haynes et al, Nat. Biotechnol. 30:423-433 (2012), Scheid et al, Nature 458:636-640 (2009), Chen et al, AIDS Res. Human Retrovirol. 23:11 (2008), Dimitrol, MAbs 2:347-356 (2010), Ma et al, PLoS Pathog. 7:e1002200 (2001), Xiao et al, Biochem. Biophys. Res. Commun. 390:404-409 (2009), Alam et al, J. Virol. 85:11725-11731 (2011), Mouquet et al, Nature 467:591-595 (2010)). This would be followed by vaccination with Envs specifically selected to stimulate somatic mutation pathways that give rise to BnAbs. Both aspects of this strategy have proved challenging due to lack of knowledge of specific Envs capable of interacting with UCAs and early intermediate (I) antibodies of BnAbs.

The present invention results, at least in part, from studies that resulted in the isolation of envelopes from a patient, CH0848, who was followed from early acute HIV-1 infection phase to over five years post-transmission. During this period CH0848 developed plasma HIV-1 neutralization breadth.

In certain aspects the invention provides Env amino acid sequences described herein and the nucleic acids encoding these, and their use as immunogens. The envelopes to be used as immunogens in accordance with the invention can be proteins, nucleic acids, or a combination.

The envelopes to be used as immunogens in accordance with the invention can be expressed for example but not limited as full gp160, gp140, gp145 with transmembrane portions, gp120s, gp120 resurfaced core proteins, gp120 outer domain constructs, or other minimal gp120 constructs.

In accordance with the invention, immunization regimens can include sequential immunizations of Env constructs selected from those encoded by the sequences as described herein, or can involve prime and boosts of combinations of Envs, or the administration of "swarms" of such sequences. Immunogenic fragments/subunits can also be used as can encoding nucleic acid sequences. Alternatively, the transmitted founder virus Env constructs can be used as primes, followed by a boost with the transmitted founder Env and sequential additions of Envs from progressively later times after transmission in patient CH848. Further, repetitive immunization can be effected with "swarms" of CH848 Envs (for example, including various combinations of the nucleic acid sequences and encoded proteins as described here) ranging from, for example but not limited to a few envelopes, e.g. 2, 4, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, or 100 Envs.

In one embodiment, the present invention relates to a method of activating an appropriate naïve B cell response in a subject (e.g., a human) by administering the CH0848 T/F Env or Env subunits that can include the gp160, gp145 with a transmembrane portion, gp41 and gp120, an uncleaved gp140, a cleaved gp140, a gp120, a gp120 subunit such as a resurfaced core (Wu X, Science 329:856-61 (2010)), an outerdomain, or a minimum epitope (the minimal epitope to avoid dominant Env non-neutralizing epitopes), followed by boosting with representatives of subsequently evolved CH848 Env variants either given in combination to mimic the high diversity observed in vivo during affinity maturation, or in series, using vaccine immunogens specifically selected to trigger the appropriate maturation pathway by high affinity binding to UCA and antibody intermediates (Haynes et al, Nat. Biotechnol. 30:423-433 (2012)). DNA, RNA, protein or vectored immunogens can be used alone or in combination. In one embodiment of the invention, transmitted founder virus envelope is administered to the subject (e.g., human) as the priming envelope and then one or more of the sequential envelopes disclosed herein is administered as a boost in an amount and under conditions such that BnAbs are produced in the subject (e.g., human). By way of example, 2, 4, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, or 100 Envs. envelopes (or subunits thereof) can be used with one prime and multiple boosts. A skilled artisan can readily determine the interval between different boosts, and the number of boosts.

The present invention includes the specific envelope proteins disclosed herein (e.g., those encoded by the sequences in the figures) and nucleic acids comprising nucleotide sequences encoding same. The envelope proteins (and subunits) can be expressed, for example, in 293T cells, 293F cells or CHO cells (Liao et al, Virology 353:268-82 (2006)). As indicated above, the envelope proteins can be expressed, for example, as gp120 or gp140 proteins and portions of the envelope proteins can be used as immunogens such as the resurfaced core protein design (RSC) (Wu et al, Science 329:856-861 (2010)); another possible design is an outer domain design (Lynch et al, J. Virol. 86:7588-95 (2012)). The invention includes immunogenic fragments/subunits of the envelope sequences disclosed herein, including fragments at least 6, 10, 20, 30, 40, 50, 60, 70, 80, 90, 100, 120, 140, 160, 180, 200, 220, 240, 260, 280 300, 320 or more amino acids in length, as well as nucleic acids comprising nucleotide sequences encoding such fragments and vectors containing same.

In other embodiments, the invention provides variants of the sequences, including variants that comprise a mutation which repairs a trypsin cleavage site, thereby preventing protein clipping during Env protein production in a cell line, e.g., a CHO cell line.

The envelopes (immunogens) can be formulated with appropriate carriers using standard techniques to yield compositions suitable for administration. The compositions can include an adjuvant, such as, for example, alum, poly IC, MF-59 or other squalene-based adjuvant, ASO1B or other liposomal based adjuvant suitable for protein immunization.

As indicated above, nucleic acid sequences (e.g., DNA sequences) encoding the immunogens can also be administered to a subject (e.g., a human) under conditions such that the immunogen is expressed in vivo and BnAbs are produced. The DNA can be present as an insert in any suitable vector. Non-limiting examples of such vectors are rAdeno-viral (Barouch, et al. Nature Med. 16: 319-23 (2010), recombinant mycobacterial (i.e., BCG or *M smegmatis*) (Yu et al. Clinical Vaccine Immunol. 14: 886-093 (2007); ibid 13: 1204-11 (2006), or recombinant vaccinia type of vector (Santra S. Nature Med. 16: 324-8 (2010)).

Immunogens of the invention, and nucleic acids (e.g., DNAs) encoding same, are suitable for use in generating an immune response (e.g., BnAbs) in a patient (e.g., a human patient) to HIV-1. The mode of administration of the immunogen, or encoding sequence, can vary with the particular immunogen, the patient and the effect sought, similarly, the dose administered. Typically, the administration route is intramuscular or subcutaneous injection (intravenous and intraperitoneal can also be used). Additionally, the formulations can be administered via the intranasal route, or intrarectally or vaginally as a suppository-like vehicle. Optimum dosing regimens can be readily determined by one skilled in the art. The immunogens (and nucleic acids encoding same) are suitable for use prophylactically, however, their administration to infected individuals may reduce viral load.

Recently, a method of making HIV vaccine immunogens based on their ability to bind to early members of a BnAb clonal lineage was proposed (PCT/US2012/000442). This method is termed B cell lineage immunogen design (Haynes et al. Nature Biotech. 30: 423-433 (2012)). This method is based on the use of clonal lineage antibody members as templates for design of HIV envelope proteins that bind well to lineage members. This method is based on the use of clonal lineage antibody members as templates for design of HIV envelope proteins that bind well to lineage members. This method is based on the principle that those antigens that bind best to naïve BnAb B cell receptors (the unmutated ancestors of mature BnAbs) will be the best immunogens for driving such a clonal lineage. Thus, mature antibodies are isolated, their intermediate ancestor and unmutated ancestor precursors inferred, and the clonal lineage tree reconstructed by Baysian probability statistics and maximum likelihood analysis, and then the tree antibodies are made by recombinant techniques (Haynes et al, Nature Biotech. 30:423-433 (2012)). Then, by screening Envs, or by solving antibody and Env structures and then rational design of Envs that optimally bind to clonal tree members, immunogens are designed and produced for vaccination studies (Haynes et al, Nature Biotech. 30:423-433 (2012)).

Regarding the choice of gp120 vs. gp160, for the genetic immunization we would normally not even consider not using gp160. However, in acute infection, gp41 non-neutralizing antibodies are dominant and overwhelm gp120 responses (Tomaras, G et al. J. Virol. 82: 12449, 2008; Liao, H X et al. JEM 208: 2237, 2011). Recently we have found that the HVTN 505 DNA prime, rAd5 vaccine trial that utilized gp140 as an immunogen, also had the dominant response of non-neutralizing gp41 antibodies. Thus, we will evaluate early on the use of gp160 vs gp120 for gp41 dominance.

In certain aspects the invention provides a strategy for induction of bnAbs is to select and develop immunogens designed to recreate the antigenic evolution of Envs that occur when bnAbs do develop in the context of infection.

That broadly neutralizing antibodies (bnAbs) occur in nearly all sera from chronically infected HIV-1 subjects suggests anyone can develop some bnAb response if exposed to immunogens via vaccination. Working back from mature bnAbs through intermediates enabled understanding their development from the unmutated ancestor, and showed that antigenic diversity preceded the development of population breadth. See Liao et al. (2013) Nature 496, 469-476.

The invention provides various methods to choose a subset of viral variants, including but not limited to envelopes, to investigate the role of antigenic diversity in serial samples. Neutralization and binding methods using sera, antibodies, and suitable viruses and envelopes are known in the art. In other aspects, the invention provides compositions comprising viral variants, for example but not limited to gp160 envelopes, selected based on various criteria as described herein to be used as immunogens.

In other aspects, the invention provides immunization strategies using the selections of immunogens to induce cross-reactive neutralizing antibodies. In certain aspects, the immunization strategies as described herein are referred to as "swarm" immunizations to reflect that multiple envelopes are used to induce immune responses. The multiple envelopes in a swarm could be combined in various immunization protocols of priming and boosting.

The invention provides an approach to select reagents for neutralization assays and subsequently investigate affinity maturation, autologous neutralization, and the transition to heterologous neutralization and breadth. Given the sustained coevolution of immunity and escape this antigen selection based on antibody and antigen coevolution has specific implications for selection of immunogens for vaccine design.

In one embodiment, 100 clones were selected that represent the selected genetic and/or antigenic diversity of the CH848 envelopes. These sets of clones represent antigenic diversity by deliberate inclusion of polymorphisms that result from immune selection by neutralizing antibodies, and had a lower clustering coefficient and greater diversity in selected sites than sets sampled randomly. These selections of clones represent various levels of antigenic diversity in the HIV-1 envelope and are based on the genetic diversity of longitudinally sampled SGA envelopes, and correlated with other factors such as antigenic/neutralization diversity, and antibody coevolution.

Sequence Variants/Clones

Described herein are nucleic and amino acids sequences of HIV-1 envelopes. In certain embodiments, the described HIV-1 envelope sequences are gp160s. In certain embodiments, the described HIV-1 envelope sequences are gp120s. Other sequence variants, for example but not limited to gp145s, gp140s, both cleaved and uncleaved, gp150s, gp41s, which are readily derived from the nucleic acid and amino acid gp160 sequences. In certain embodiments the nucleic acid sequences are codon optimized for optimal expression in a host cell, for example a mammalian cell, a rBCG cell or any other suitable expression system.

In certain embodiments, the envelope design in accordance with the present invention involves deletion of residues (e.g., 5-11, 5, 6, 7, 8, 9, 10, or 11 amino acids) at the N-terminus. For delta N-terminal design, amino acid residues ranging from 4 residues or even fewer to 14 residues or even more are deleted. These residues are between the maturation (signal peptide, usually ending with CX, X can be any amino acid) and "VPVXXXX . . . ".

In other embodiments, the delta N-design described for CH848 T/F envelope in FIG. 4 can be used to make delta N-designs of other CH848 envelopes (See e.g. FIG. 5). In certain embodiments, the invention relates generally to an immunogen, gp160, gp120 or gp140, without an N-terminal Herpes Simplex gD tag substituted for amino acids of the N-terminus of gp120, with an HIV leader sequence (or other leader sequence), and without the original about 4 to about 25, for example 11, amino acids of the N-terminus of the envelope (e.g. gp120). See WO2013/006688, e.g. at pages 10-12, the contents of which publication is hereby incorporated by reference in its entirety.

The general strategy of deletion of N-terminal amino acids of envelopes results in proteins, for example gp120s, expressed in mammalian cells that are primarily monomeric, as opposed to dimeric, and, therefore, solves the production and scalability problem of commercial gp120 Env vaccine production. In other embodiments, the amino acid deletions at the N-terminus result in increased immunogenicity of the envelopes.

In certain embodiments, the invention provides envelope sequences, amino acid sequences and the corresponding nucleic acids, and in which the V3 loop is substituted with the following V3 loop sequence TRPNNNTRKSIRIG-PGQTFY ATGDIIGNIRQAH (SEQ ID NO: 1). This substitution of the V3 loop reduced product cleavage and improves protein yield during recombinant protein production in CHO cells.

In certain embodiments, the CH848 envelopes will have added certain amino acids to enhance binding of various broad neutralizing antibodies.

In certain aspects, the invention provides composition and methods which use a selection of sequential CH848 Envs, as gp120s, gp 145s, gp150s, gp 140s cleaved and uncleaved and gp160s, as proteins, DNAs, RNAs, or any combination thereof, administered as primes and boosts to elicit immune response. Sequential CH848 Envs as proteins would be co-administered with nucleic acid vectors containing Envs to amplify antibody induction. In certain embodiments, the compositions and methods include any immunogenic HIV-1 sequences to give the best coverage for T cell help and cytotoxic T cell induction. In certain embodiments, the compositions and methods include mosaic and/or consensus HIV-1 genes to give the best coverage for T cell help and cytotoxic T cell induction. In certain embodiments, the compositions and methods include mosaic group M and/or consensus genes to give the best coverage for T cell help and cytotoxic T cell induction. In some embodiments, the mosaic genes are any suitable gene from the HIV-1 genome. In some embodiments, the mosaic genes are Env genes, Gag genes, Pol genes, Nef genes, or any combination thereof. See e.g. U.S. Pat. No. 7,951,377. In some embodiments the mosaic genes are bivalent mosaics. In some embodiments the mosaic genes are trivalent. In some embodiments, the mosaic genes are administered in a suitable vector with each immunization with Env gene inserts in a suitable vector and/or as a protein. In some embodiments, the mosaic genes, for example as bivalent mosaic Gag group M consensus genes, are administered in a suitable vector, for example but not limited to HSV-1, would be administered with each immunization with Env gene inserts in a suitable vector, for example but not limited to HSV-2.

In certain aspects the invention provides compositions and methods of Env genetic immunization either alone or with Env proteins to recreate the swarms of evolved viruses that have led to bnAb induction. Nucleotide-based vaccines offer a flexible vector format to immunize against virtually any protein antigen. Currently, two types of genetic vaccination are available for testing—DNAs and mRNAs.

In certain aspects the invention contemplates using immunogenic compositions wherein immunogens are delivered as DNA. See Graham B S, Enama M E, Nason M C, Gordon I J, Peel S A, et al. (2013) DNA Vaccine Delivered by a Needle-Free Injection Device Improves Potency of Priming for Antibody and CD8+ T-Cell Responses after rAd5 Boost in a Randomized Clinical Trial. PLoS ONE 8(4): e59340, page 9. Various technologies for delivery of nucleic acids, as DNA and/or RNA, so as to elicit immune response, both T-cell and humoral responses, are known in the art and are under developments. In certain embodiments, DNA can be delivered as naked DNA. In certain embodiments, DNA is formulated for delivery by a gene gun. In certain embodiments, DNA is administered by electroporation, or by needle-free injection technologies, for example but not limited to Biojector® device. In certain embodiments, the DNA is inserted in vectors. The DNA is delivered using a suitable vector for expression in mammalian cells. In certain embodiments the nucleic acids encoding the envelopes are optimized for expression. In certain embodiments DNA is optimized, e.g. codon optimized, for expression. In certain embodiments the nucleic acids are optimized for expression in vectors and/or in mammalian cells. In non-limiting embodiments these are bacterially derived vectors, adenovirus based vectors, rAdenovirus (Barouch D H, et al. Nature Med. 16: 319-23, 2010), recombinant mycobacteria (i.e., rBCG or *M smegmatis*) (Yu, J S et al. Clinical Vaccine Immunol. 14: 886-093, 2007; ibid 13: 1204-11, 2006), and recombinant vaccinia type of vectors (Santra S. Nature Med. 16: 324-8, 2010), for example but not limited to ALVAC, replicating (Kibler K V et al., PLoS One 6: e25674, 2011 nov 9.) and non-replicating (Perreau M et al. J. virology 85: 9854-62, 2011) NYVAC, modified vaccinia Ankara (MVA)), adeno-associated virus, Venezuelan equine encephalitis (VEE) replicons, Herpes Simplex Virus vectors, and other suitable vectors.

In certain aspects the invention contemplates using immunogenic compositions wherein immunogens are delivered as DNA or RNA in suitable formulations. Various technologies which contemplate using DNA or RNA, or may use complexes of nucleic acid molecules and other entities to be used in immunization. In certain embodiments, DNA or RNA is administered as nanoparticles consisting of low dose antigen-encoding DNA formulated with a block copolymer (amphiphilic block copolymer 704). See Cany et al., Journal of Hepatology 2011 vol. 54 j 115-121; Arnaoty et al., Chapter 17 in Yves Bigot (ed.), Mobile Genetic Elements: Protocols and Genomic Applications, Methods in Molecular Biology, vol. 859, pp 293-305 (2012); Arnaoty et al. (2013) Mol Genet Genomics. 2013 August; 288(7-8):347-63. Nanocarrier technologies called Nanotaxi® for immunogenic macromolecules (DNA, RNA, Protein) delivery are under development. See e.g. InCellArt research and development technologies.

In certain aspects the invention contemplates using immunogenic compositions wherein immunogens are delivered as recombinant proteins. Various methods for production and purification of recombinant proteins suitable for use in immunization are known in the art.

The immunogenic envelopes can also be administered as a protein boost in combination with a variety of nucleic acid envelope primes (e.g., HIV-1 Envs delivered as DNA expressed in viral or bacterial vectors).

Dosing of proteins and nucleic acids can be readily determined by a skilled artisan. A single dose of nucleic acid can range from a few nanograms (ng) to a few micrograms (μg) or milligram of a single immunogenic nucleic acid. Recombinant protein dose can range from a few μg micrograms to a few hundred micrograms, or milligrams of a single immunogenic polypeptide.

Administration: The compositions can be formulated with appropriate carriers using known techniques to yield compositions suitable for various routes of administration. In certain embodiments the compositions are delivered via intramascular (IM), via subcutaneous, via intravenous, via nasal, via mucosal routes.

In certain embodiment, nucleic acids and proteins could be administered together, either in the same formulation or in different formulations, or could be administered simultaneously at the same or different immunization sites.

The compositions can be formulated with appropriate carriers and adjuvants using techniques to yield compositions suitable for immunization. The compositions can include an adjuvant, such as, for example but not limited to, alum, poly IC, MF-59 or other squalene-based adjuvant, ASOIB, or other liposomal based adjuvant suitable for protein or nucleic acid immunization. In certain embodiments, TLR agonists are used as adjuvants. In other embodiment, adjuvants which break immune tolerance are included in the immunogenic compositions. In certain embodiments, the methods and compositions comprise any suitable agent or immune modulation which could modulate mechanisms of host immune tolerance and release of the induced antibodies. In non-limiting embodiments modulation includes PD-1 blockade; T regulatory cell depletion; CD40L hyperstimulation; soluble antigen administration, wherein the soluble antigen is designed such that the soluble agent eliminates B cells targeting dominant epitopes, or a combination thereof. In certain embodiments, an immunomodulatory agent is administered in at time and in an amount sufficient for transient modulation of the subject's immune response so as to induce an immune response which comprises broad neutralizing antibodies against HIV-1 envelope. Non-limiting examples of such agents is any one of the agents described herein: e.g. chloroquine (CQ), PTP1B Inhibitor-CAS 765317-72-4-Calbiochem or MSI 1436 clodronate or any other bisphosphonate; a Foxo1 inhibitor, e.g. 344355 |Foxo1 Inhibitor, AS1842856-Calbiochem; Gleevac, anti-CD25 antibody, anti-CCR4 Ab, an agent which binds to a B cell receptor for a dominant HIV-1 envelope epitope, or any combination thereof. In certain embodiments, the methods comprise administering a second immunomodulatory agent, wherein the second and first immunomodulatory agents are different.

There are various host mechanisms that control bNAbs. For example highly somatically mutated antibodies become autoreactive and/or less fit (Immunity 8: 751, 1998; PloS Comp. Biol. 6 e1000800, 2010; J. Thoret. Biol. 164:37, 1993); Polyreactive/autoreactive naïve B cell receptors (unmutated common ancestors of clonal lineages) can lead to deletion of Ab precursors (Nature 373: 252, 1995; PNAS 107: 181, 2010; J. Immunol. 187: 3785, 2011); Abs with long HCDR3 can be limited by tolerance deletion (JI 162: 6060, 1999; JCI 108: 879, 2001). BnAb knock-in mouse models are providing insights into the various mechanisms of tolerance control of MPER BnAb induction (deletion, anergy, receptor editing). Other variations of tolerance control likely will be operative in limiting BnAbs with long HCDR3s, high levels of somatic hypermutations. 2F5 and 4E10 BnAbs were induced in mature antibody knock-in mouse models with MPER peptide-liposome-TLR immunogens. Next step is immunization of germline mouse models and humans with the same immunogens.

Table 1 below summarizes sequences listed in FIGS. 5, 6, 7, and 8.

| | Plasmid ID | Env Name | Plasmid ID | Env Name |
|---|---|---|---|---|
| 1. | HV1300892 | CH848.3.d0078.30.02D11gp120 | HV1300815 | CH848.3.d0078.30.02gp140C |
| 2. | HV1300893 | CH848.3.d0078.30.42D11gp120 | HV1300816 | CH848.3.d0078.30.42gp140C |
| 3. | HV1300894 | CH848.3.d0107.30.12D11gp120 | HV1300817 | CH848.3.d0107.30.12gp140C |
| 4. | HV1300895 | CH848.3.d0107.30.27D11gp120 | HV1300818 | CH848.3.d0107.30.27gp140C |
| 5. | HV1300896 | CH848.3.d0107.30.31D11gp120 | HV1300819 | CH848.3.d0107.30.31gp140C |
| 6. | HV1300897 | CH848.3.d0135.27.03D11gp120 | HV1300820 | CH848.3.d0135.27.03gp140C |
| 7. | HV1300898 | CH848.3.d0135.27.06D11gp120 | HV1300821 | CH848.3.d0135.27.06gp140C |
| 8. | HV1300899 | CH848.3.d0135.60.05D11gp120 | HV1300822 | CH848.3.d0135.60.05gp140C |
| 9. | HV1300900 | CH848.3.d0135.60.14D11gp120 | HV1300823 | CH848.3.d0135.60.14gp140C |
| 10 | HV1300901 | CH848.3.d0135.60.19D11gp120 | HV1300824 | CH848.3.d0135.60.19gp140C |
| 11 | HV1300902 | CH848.3.d0135.60.20D11gp120 | HV1300825 | CH848.3.d0135.60.20gp140C |
| 12 | HV1300903 | CH848.3.d0135.60.32D11gp120 | HV1300826 | CH848.3.d0135.60.32gp140C |
| 13 | HV1300904 | CH848.3.d0135.60.34D11gp120 | HV1300827 | CH848.3.d0135.60.34gp140C |
| 14 | HV1300905 | CH848.3.d0194.25.17D11gp120 | HV1300828 | CH848.3.d0194.25.17gp140C |
| 15 | HV1300906 | CH848.3.d0194.25.21D11gp120 | HV1300829 | CH848.3.d0194.25.21gp140C |
| 16 | HV1300907 | CH848.3.d0194.25.24D11gp120 | HV1300830 | CH848.3.d0194.25.24gp140C |
| 17 | HV1300908 | CH848.3.d0194.25.48D11gp120 | HV1300831 | CH848.3.d0194.25.48gp140C |
| 18 | HV1300909 | CH848.3.d0274.30.02D11gp120 | HV1300832 | CH848.3.d0274.30.02gp140C |
| 19 | HV1300910 | CH848.3.d0274.30.07D11gp120 | HV1300833 | CH848.3.d0274.30.07gp140C |
| 20 | HV1300911 | CH848.3.d0274.30.09D11gp120 | HV1300834 | CH848.3.d0274.30.09gp140C |
| 21 | HV1300912 | CH848.3.d0274.30.14D11gp120 | HV1300835 | CH848.3.d0274.30.14gp140C |
| 22 | HV1300913 | CH848.3.d0358.80.03D11gp120 | HV1300836 | CH848.3.d0358.80.03gp140C |
| 23 | HV1300914 | CH848.3.d0358.80.06D11gp120 | HV1300837 | CH848.3.d0358.80.06gp140C |
| 24 | HV1300915 | CH848.3.d0358.80.17D11gp120 | HV1300838 | CH848.3.d0358.80.17gp140C |
| 25 | HV1300916 | CH848.3.d0358.80.44D11gp120 | HV1300839 | CH848.3.d0358.80.44gp140C |
| 26 | HV1300917 | CH848.3.d0445.25.04D11gp120 | HV1300840 | CH848.3.d0445.25.04gp140C |
| 27 | HV1300918 | CH848.3.d0445.25.18D11gp120 | HV1300841 | CH848.3.d0445.25.18gp140C |
| 28 | HV1300919 | CH848.3.d0445.25.26D11gp120 | HV1300842 | CH848.3.d0445.25.26gp140C |
| 29 | HV1300920 | CH848.3.d0445.30.41D11gp120 | HV1300843 | CH848.3.d0445.30.41gp140C |
| 30 | HV1300921 | CH848.3.d0445.30.42D11gp120 | HV1300844 | CH848.3.d0445.30.42gp140C |
| 31 | HV1300922 | CH848.3.d0526.25.02D11gp120 | HV1300845 | CH848.3.d0526.25.02gp140C |
| 32 | HV1300923 | CH848.3.d0526.25.09D11gp120 | HV1300846 | CH848.3.d0526.25.09gp140C |
| 33 | HV1300924 | CH848.3.d0526.25.10D11gp120 | HV1300847 | CH848.3.d0526.25.10gp140C |
| 34 | HV1300925 | CH848.3.d0526.25.11D11gp120 | HV1300848 | CH848.3.d0526.25.11gp140C |
| 35 | HV1300926 | CH848.3.d0526.25.21D11gp120 | HV1300849 | CH848.3.d0526.25.21gp140C |
| 36 | HV1300927 | CH848.3.d0526.25.32D11gp120 | HV1300850 | CH848.3.d0526.25.32gp140C |
| 37 | HV1300928 | CH848.3.d0526.25.39D11gp120 | HV1300851 | CH848.3.d0526.25.39gp140C |
| 38 | HV1300929 | CH848.3.d0611.9.02D11gp120 | HV1300852 | CH848.3.d0611.9.02gp140C |
| 39 | HV1300930 | CH848.3.d0611.20.12D11gp120 | HV1300853 | CH848.3.d0611.20.12gp140C |
| 40 | HV1300931 | CH848.3.d0611.20.14D11gp120 | HV1300854 | CH848.3.d0611.20.14gp140C |
| 41 | HV1300932 | CH848.3.d0611.20.28D11gp120 | HV1300855 | CH848.3.d0611.20.28gp140C |
| 42 | HV1300933 | CH848.3.d0700.15.06D11gp120 | HV1300856 | CH848.3.d0700.15.06gp140C |
| 43 | HV1300934 | CH848.3.d0700.15.15D11gp120 | HV1300857 | CH848.3.d0700.15.15gp140C |
| 44 | HV1300935 | CH848.3.d0700.15.29D11gp120 | HV1300858 | CH848.3.d0700.15.29gp140C |
| 45 | HV1300936 | CH848.3.d0700.27.06D11gp120 | HV1300859 | CH848.3.d0700.27.06gp140C |
| 46 | HV1300937 | CH848.3.d0794.5.27D11gp120 | HV1300860 | CH848.3.d0794.5.27gp140C |
| 47 | HV1300938 | CH848.3.d0794.5.41D11gp120 | HV1300861 | CH848.3.d0794.5.41gp140C |
| 48 | HV1300939 | CH848.3.d0836.10.36D11gp120 | HV1300862 | CH848.3.d0836.10.36gp140C |
| 49 | HV1300940 | CH848.3.d0864.7.26D11gp120 | HV1300863 | CH848.3.d0864.7.26gp140C |
| 50 | HV1300941 | CH848.3.d0864.7.39D11gp120 | HV1300864 | CH848.3.d0864.7.39gp140C |
| 51 | HV1300942 | CH848.3.d0893.10.06D11gp120 | HV1300865 | CH848.3.d0893.10.06gp140C |
| 52 | HV1300943 | CH848.3.d1120.10.13D11gp120 | HV1300866 | CH848.3.d1120.10.13gp140C |
| 53 | HV1300944 | CH848.3.d1120.10.21D11gp120 | HV1300867 | CH848.3.d1120.10.21gp140C |
| 54 | HV1300945 | CH848.3.d1120.10.24D11gp120 | HV1300868 | CH848.3.d1120.10.24gp140C |
| 55 | HV1300946 | CH848.3.d1120.10.32D11gp120 | HV1300869 | CH848.3.d1120.10.32gp140C |
| 56 | HV1300947 | CH848.3.d1120.10.41D11gp120 | HV1300870 | CH848.3.d1120.10.41gp140C |
| 57 | HV1300948 | CH848.3.d1305.10.13D11gp120 | HV1300871 | CH848.3.d1305.10.13gp140C |
| 58 | HV1300949 | CH848.3.d1305.10.21D11gp120 | HV1300872 | CH848.3.d1305.10.21gp140C |
| 59 | HV1300950 | CH848.3.d1305.10.30D11gp120 | HV1300873 | CH848.3.d1305.10.30gp140C |
| 60 | HV1300951 | CH848.3.d1305.10.35D11gp120 | HV1300874 | CH848.3.d1305.10.35gp140C |
| 61 | HV1300952 | CH848.3.d1432.5.18D11gp120 | HV1300875 | CH848.3.d1432.5.18gp140C |
| 62 | HV1300953 | CH848.3.d1432.5.27D11gp120 | HV1300876 | CH848.3.d1432.5.27gp140C |
| 63 | HV1300954 | CH848.3.d1432.5.41D11gp120 | HV1300877 | CH848.3.d1432.5.41gp140C |
| 64 | HV1300955 | CH848.3.d1432.5.50D11gp120 | HV1300878 | CH848.3.d1432.5.50gp140C |
| 65 | HV1300956 | CH848.3.d1432.5.56D11gp120 | HV1300879 | CH848.3.d1432.5.56gp140C |
| 66 | HV1300957 | CH848.3.d1621.4.12D11gp120 | HV1300880 | CH848.3.d1621.4.12gp140C |
| 67 | HV1300958 | CH848.3.d1621.4.15D11gp120 | HV1300881 | CH848.3.d1621.4.15gp140C |
| 68 | HV1300959 | CH848.3.d1621.4.25D11gp120 | HV1300882 | CH848.3.d1621.4.25gp140C |

-continued

| Plasmid ID | Env Name | Plasmid ID | Env Name |
|---|---|---|---|
| 69 HV1300960 | CH848.3.d1621.4.31D11gp120 | HV1300883 | CH848.3.d1621.4.31gp140C |
| 70 HV1300961 | CH848.3.d1621.4.44D11gp120 | HV1300884 | CH848.3.d1621.4.44gp140C |
| 71 HV1300962 | CH848.3.d1621.4.46D11gp120 | HV1300885 | CH848.3.d1621.4.46gp140C |
| 72 HV1300963 | CH848.3.d1635.10.35D11gp120 | HV1300886 | CH848.3.d1635.10.35gp140C |
| 73 HV1300964 | CH848.3.d1651.7.34D11gp120 | HV1300887 | CH848.3.d1651.7.34gp140C |
| 74 HV1300965 | CH848.3.d1651.7.50D11gp120 | HV1300888 | CH848.3.d1651.7.50gp140C |
| 75 HV1300966 | CH848.3.d1651.10.04D11gp120 | HV1300889 | CH848.3.d1651.10.04gp140C |
| 76 HV1300967 | CH848.3.d1677.521.D11gp120 | HV1300890 | CH848.3.d1677.521.gp140C |
| 77 HV1300968 | CH848.3.d1720.5D11gp120 | HV1300891 | CH848.3.d1720.5gp140C |
| 78 HV1301011 | CH0848d0526.25.26D11gp120 | HV1301062 | CH0848d0526.25.26gp140C |
| 79 HV1301012 | CH0848d0700.15.34D11gp120 | HV1301063 | CH0848d0700.15.34gp140C |
| 80 HV1301013 | CH0848d0780.25.05D11gp120 | HV1301064 | CH0848d0780.25.05gp140C |
| 81 HV1301014 | CH0848d0700.15.05D11gp120 | HV1301065 | CH0848d0700.15.05gp140C |
| 82 HV1301015 | CH0848d0794.3.03D11gp120 | HV1301066 | CH0848d0794.3.03gp140C |
| 83 HV1301016 | CH0848d0836.10.31D11gp120 | HV1301067 | CH0848d0836.10.31gp140C |
| 84 HV1301017 | CH0848d0808.15.27D11gp120 | HV1301068 | CH0848d0808.15.27gp140C |
| 85 HV1301018 | CH0848d0949.10.18D11gp120 | HV1301069 | CH0848d0949.10.18gp140C |
| 86 HV1301019 | CH0848d0808.15.25D11gp120 | HV1301070 | CH0848d0808.15.25gp140C |
| 87 HV1301020 | CH0848d0864.3.03D11gp120 | HV1301071 | CH0848d0864.3.03gp140C |
| 88 HV1301021 | CH0848d0893.10.05D11gp120 | HV1301072 | CH0848d0893.10.05gp140C |
| 89 HV1301022 | CH0848d0949.10.10D11gp120 | HV1301073 | CH0848d0949.10.10gp140C |
| 90 HV1301023 | CH0848d0949.10.17D11gp120 | HV1301074 | CH0848d0949.10.17gp140C |
| 91 HV1301024 | CH0848d0808.15.15D11gp120 | HV1301075 | CH0848d0808.15.15gp140C |
| 92 HV1301025 | CH0848d0780.15.22D11gp120 | HV1301076 | CH0848d0780.15.22gp140C |
| 93 HV1301026 | CH0848d0780.15.29D11gp120 | HV1301077 | CH0848d0780.15.29gp140C |
| 94 HV1301027 | CH0848d0808.15.43D11gp120 | HV1301078 | CH0848d0808.15.43gp140C |
| 95 HV1301028 | CH0848d1120.10.05D11gp120 | HV1301079 | CH0848d1120.10.05gp140C |
| 96 HV1301029 | CH0848d1432.5.06D11gp120 | HV1301080 | CH0848d1432.5.06gp140C |
| 97 HV1301030 | CH0848d1432.5.48D11gp120 | HV1301081 | CH0848d1432.5.48gp140C |
| 98 HV1301031 | CH0848d1432.5.35D11gp120 | HV1301082 | CH0848d1432.5.35gp140C |
| 99 HV1301032 | CH0848d1651.10.07D11gp120 | HV1301083 | CH0848d1651.10.07gp140C |
| 10 HV1301058 | CH0848d1432.5.26D11gp120 | HV1301084 | CH0848d1432.5.26gp140C |

The invention is further described in the non-limiting examples below.

EXAMPLES

Example 1

Provided herein are non-limiting examples of combinations of antigens derived from CH848 envelope sequences for a swarm immunization. The selection includes priming with a virus which binds to a UCA, for example a T/F virus or another early virus envelope. In certain embodiments the prime could include D-loop variants.

Non-limiting embodiments of envelopes selected for swarm vaccination are shown as the selections described below. A skilled artisan would appreciate that a vaccination protocol can include a sequential immunization starting with the "prime" envelope(s) and followed by sequential boosts, which include individual envelopes or combination of envelopes. In another vaccination protocol, the sequential immunization starts with the "prime" envelope(s) and is followed with boosts of cumulative prime and/or boost envelopes. In certain embodiments, there is some variance in the immunization regimen; in some embodiments, the selection of HIV-1 envelopes may be grouped in various combinations of primes and boosts, either as nucleic acids, proteins, or combinations thereof. In certain embodiments the immunization includes a prime administered as DNA, and MVA boosts. See Goepfert, et al. 2014; "Specificity and 6-Month Durability of Immune Responses Induced by DNA and Recombinant Modified Vaccinia Ankara Vaccines Expressing HIV-1 Virus-Like Particles" J Infect Dis. 2014 Feb. 9. [Epub ahead of print].

In a non-limiting embodiment, the immunization protocol is the following: prime with T/F, and then boost with the next 15 envelopes, then boost with the next 17 envelopes, then boost with the next 34 envelopes and then boost with the next 33 envelopes (FIG. 1).

The contents of all documents and other information sources cited herein are incorporated by reference in their entirety.

SEQUENCE LISTING (830 sequences)

SEQ ID NO: 1 - protein, 33 aa, Artificial Sequence
  Description of Artificial Sequence: Synthetic polypeptide
TRPNNNTRKSIRIGPGQTFYATGDIIGNIRQAH

SEQ ID NO: 2 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 3 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 4 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWSKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 5 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASNAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 6 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGHITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 7 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 8 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 9 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 10 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTHSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRLFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEVIQRFCRAIRNIPTRIRQGFEASLL

SEQ ID NO: 11 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEEIQRFCRAIRNIPTRIRQGFEASLL

SEQ ID NO: 12 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGREVLKYLGSLVQYWGLELKKSAISLFDTIAIAVAEGTDRIIEGIQRFCRAIRNIPTRIRQGFEASLL

SEQ ID NO: 13 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 14 - protein, 866 aa, Artificial Sequence
  Description of Artificial Sequence: Synthetic polypeptide
MKVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSSITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTDVPWNTSWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 15 - protein, 866 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNNSWSNKSEKDIWDNMTWMQWEREISNYTETIYMLLEDSQHQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 16 - protein, 870 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNASWSNKSEKDIWDNMTWMQWEREISNYTETIYMLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVNGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 17 - protein, 870 aa, Artificial Sequence
  Description of Artificial Sequence: Synthetic polypeptide
MRVRGILKNYPQWWIWGILGFWMLMICNGKGKLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNASWSNKSEKDIWDNMTWMQWEREISNYTETIYMLLEDSQRQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 18 - protein, 866 aa, Artificial Sequence
  Description of Artificial Sequence: Synthetic polypeptide
MRVMGIPKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNAIVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGARRRVVEREKRAAGLGALFLGFLGAAGSTMGAASITLTVQARQLLSGIVQQQSNLLRAIEAQQHMLQLTIWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIRIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 19 - protein, 866 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELGLENVTENFNMWKNDMVDQMHEDIISLWDQSLKPCVKLTPLCVTLKCSNAIVDSSKVYDTRSKVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWDTNWSNKSEKDIWDNMTWMQWEREISNYTETIYKLLEDSQHQQERNEQDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFNTIAIAVAEGTDRIIEGIQRFCRAIRNIPTRIRQGFEASLL

SEQ ID NO: 20 - protein, 866 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNSSWSNKSEKDIWDNMTWMQWEREISNYTETIYKLLEDSQHQQERNEQDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIELIQRFCRAIRNIPTRIRQGFEASLL

SEQ ID NO: 21 - protein, 866 aa, Artificial Sequence
  Description of Artificial Sequence: Synthetic polypeptide
MRVMGIPKNYPQWWIWGILGFWILMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCNSATVDNSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNDKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEGIQRFCRAIRNIPTRIRQGFEASLL

SEQ ID NO: 22 - protein, 854 aa, Artificial Sequence
  Description of Artificial Sequence: Synthetic polypeptide
MRVMGIPKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFNTIAIAVAEGTDRIIKVIQRFCRAIRNIPTRIRQGFEASLL

SEQ ID NO: 23 - protein, 866 aa, Artificial Sequence
  Description of Artificial Sequence: Synthetic polypeptide
MRVMGILKNYLQWWIWGILGFWMLMICKGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLTCSNATVDNSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWYKTLQEVGKELQKHFPNKTIKYERSAGGDMEIATHSFNCGGEFFYCNTSNLFNGTYNGTYISINSTSYITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 24 - protein, 854 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQEVGKELQKHFPNKTIKYERSAGGDMEIATHSFNCGGEFFYCNTSNLFNGTYNGTDISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNASWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFNTIAIAVAEGTDRIIEGIQRFCRAIRNIPTRIRQGFEASLL

SEQ ID NO: 25 - protein, 856 aa, Artificial Sequence
  Description of Artificial Sequence: Synthetic polypeptide
MKVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEGQWNKTLQEVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLRRSSLRGLQRGWEVLKYLGSLVQYWGLELKKSAISLLDTIAIAVAEGTDRIIEVIQRSCRAIRNIPTRIRQGFEASLL

SEQ ID NO: 26 - protein, 856 aa, Artificial Sequence
  Description of Artificial Sequence: Synthetic polypeptide
MRVMGILKNYPQWWIWGILGFWMLMNCNGKGNLWVTVYYGVPVWKEAKTTLFCASDAKAYKKEVHNVWATHACVPTDPSPQELVLENVTENFNMWKNDMVDQMHEDIISLWDQSLKPCVKLTPLCVTLNCSNARSNVNVTSINNTIMGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLLDTIAIAVAEGTDRIIEVIQRSCRAIRNIPTRIRQGFEASLL

SEQ ID NO: 27 - protein, 852 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLNCSNVSNVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEIATHSFNCGGEFFYCNTSNLFNGTYNGTYSTNSTSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICNTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPTRIRQGFEASLL

SEQ ID NO: 28 - protein, 853 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLDNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSKLFNGTYNGTYISTNSTSYITLQCRIKQIINMWQGVGRAMYAPPIAGNITCKSNITGLLLTRDGGTNNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLLDTIAIAVAEGTDRIIEVIQGFCRAIRNIPTRIRQGFEASLL

SEQ ID NO: 29 - protein, 857 aa, Artificial Sequence
  Description of Artificial Sequence: Synthetic polypeptide
MRVMGILKNYPPWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLNCSNVNVVNVTNITNTIKGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSNLFNGTYNGTYISTNSSANSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLLDTIAIAVAEGTDRIIEVIQGFCRAIRNIPTRIRQGFEASLL

SEQ ID NO: 30 - protein, 855 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLDCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSNLFNGTYNGTYINISTNSNSTITLQCRIKQIINMWQGVGRAMYAPPIAGNITCRSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNSSWSNKSEKDIWDNMTWMQWEREISNYTETIYTLLEDSQRQQERNEKDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEIIQGFCRAIRNIPTRIRQGFEASLL

SEQ ID NO: 31 - protein, 848 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 32 - protein, 857 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGKYINISTNSNSTITLQCRIKQIINMWQGVGRAMYAPPIAGNITCKSNITGLLLTRDGGTKNNSTETEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTDVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 33 - protein, 855 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQEVGKELQKHFPNKTIKYERSAGGDMEITTHSFNCGGEFFYCNTSNLFNGTYNGPYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPTRIRQGFEASLL

SEQ ID NO: 34 - protein, 866 aa, Artificial Sequence
  Description of Artificial Sequence: Synthetic polypeptide
MKVMGILKNYPQWWIWGILGFWMLMICKGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRNRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 35 - protein, 861 aa, Artificial Sequence
  Description of Artificial Sequence: Synthetic polypeptide
TRVMGILKNYPQWWIWGILGFWMLMICNGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTRSNVNVTNITNTIKGEMKNCSFNTTTEIRDKEKKEYALFYRSDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLHEVSKELQKHFPNKTIKYAQSAGGDMEITTHSFNCGGEFFYCNTSNLFNGTYNGTYISTNSSANSNSTITLQCRIKQIINMWQGVGRAMYAPPIAGNITCRSNITGLLLTRDGGTKNNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLRTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 36 - protein, 857 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 37 - protein, 864 aa, Artificial Sequence
  Description of Artificial Sequence: Synthetic polypeptide
MRVMGIPKNYPQWWIWGILGFWMLMICSGRGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLICSNATVNNRTVYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSKLFNGTYNGINISTNSNSTITLQCRIKQIINMWQGVGRAMYAPPIAGNITCKSNITGLLLTRDGGNRNNSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 38 - protein, 864 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTVYDTRSNANVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTTVAWNTSWSNKSEKDIWDNMTWMQWEREISNYTETIYTLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQGFCRAIRNIPTRIRQGFEASLL

SEQ ID NO: 39 - protein, 866 aa, Artificial Sequence
  Description of Artificial Sequence: Synthetic polypeptide
MRVMGILKNCPQWWIWGILGFWMLMICNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYDTRSNVSVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPSNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYTNISTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIKIFIMIVGGLICLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPTRIRQGFEASLL

SEQ ID NO: 40 - protein, 848 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGAIIGDIRQAHCNISESKWNETLQKVGKELQKHFPNKTIKYEQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 41 - protein, 851 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSNATVNNRTVYEMKNCSFNTTTEIRDKEKKEYALFYRSDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGEIRQAHCNISESKWNETLQKVGKELQKHFPNKTIKYERSAGGDMEITTHSFNCGGEFFYCNTSKLFNGTYNGTDISTNSSANSNSTITLQCRIKQIINIWQGVGRAMYAPPIAGNITCKSNITGLLLTRDGGNNNNRNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPTRIRQGFEASLL

SEQ ID NO: 42 - protein, 852 aa, Artificial Sequence
  Description of Artificial Sequence: Synthetic polypeptide
MRVTGILKNYPQWWIWGILGFWMLMTCNGEGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESEWNETLQKVGKELQKHFPNKTIKYEQSAGGDMEITTHSFNCGGEFFYCNTAELFNGTYNGTDISTNSSANSTSTITLQCRIKQIINMWQGVGRAMYAPPIAGNITCRSNITGLLLTRDGGINNVSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKRSAISLFDTLAIAVAEGTDRIIELIQGFCRAIRNIPTRIRQGFEASLL

SEQ ID NO: 43 - protein, 852 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGNELQKHFPNKTIKYEQAAGGDMEITTHSFNCGGEFFYCNTANLFNGTYNGTDISTNSSANSTSTITLQCKIKQIINMWQGVGRAMYAPPIAGNITCRSNITGLLLTRDGGINNVSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKKGAISLFDTLAITVAEGTDRIIEVIQGFCRAIRNIPTRIRQGFEASLL

SEQ ID NO: 44 - protein, 852 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVSLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHAPVEIVCTRPGHNTRKSVRIGPGQTFYATGDIIGNIRQAHCNINESEWNETLQKVGKELRKHFPNKTIKYEQSAGGDMEITTHSFNCGGEFFYCNTANLFNGTYNGTDISTNSSADRNSTITLECKIKQIINMWQGVGRAMYAPPIAGNITCRSNITGLLLTRDGGINNVSNATETFRPAGGDMRDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKRSTISLFDTLAIAVAEGTDRIIELIQGFCRAIRNIPTRIRQGFEASLL

SEQ ID NO: 45 - protein, 848 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYEMKNCSFNTTTEIRDKEKKEYALFYRPDIVPLGETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTVVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPTRIRQGFEASLL

SEQ ID NO: 46 - protein, 848 aa, Artificial Sequence
  Description of Artificial Sequence: Synthetic polypeptide
MRVMGILKNCPQWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNKTFNGTGPCSKVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEGIQRFCRAIRNIPTRIRQGFEASLL

SEQ ID NO: 47 - protein, 849 aa, Artificial Sequence
  Description of Artificial Sequence: Synthetic polypeptide
MKVMGIPKNYPQWWIWGILGFWMLMNCNGKENLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSKLFNGTYNGTDISTNSSANSNSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIKVIQGFCRAIRNIPTRIRQGFEASLL

SEQ ID NO: 48 - protein, 870 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWDSSWSNKSEKDIWDNMTWMQWEREISNYTETIYKLLEDSQNQQERNEQDLLALDSWNSLWNWFNITNWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQGFCRAIRNIPTRIRQGFEASLL

SEQ ID NO: 49 - protein, 849 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQRSCRAIRNIPTRIRQGFEASLL

SEQ ID NO: 50 - protein, 849 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNNRVDQMHEDIISLWDQSLKPCVKLTPLCVTLICSNATVDNRTVGEMKNCSFNTTTEIRDKEKKEYALFYKPDVVPLDETNNTSEYRLINCNTSAVTQACPKVTFEPIPIHYCAPAGYAILKCNNETFNRTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQRSCRAIRNIPTRIRQGFEASLL

SEQ ID NO: 51 - protein, 866 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERPAGGDLEITTHSFNCGGEFFYCNTSKLFNGTYNGTDISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIKIFIIIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 52 - protein, 868 aa, Artificial Sequence
  Description of Artificial Sequence: Synthetic polypeptide
TRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTDYDTRSNVNVTNITNTIKGEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 53 - protein, 870 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNKVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSIVQYWGLELKKSAISLFDTLAIAVAEGTDRFIEVIQRFCRAIRNIPTRIRQGFEASLL

SEQ ID NO: 54 - protein, 851 aa, Artificial Sequence
  Description of Artificial Sequence: Synthetic polypeptide
MRVMGILKNYPQWWIWGILGFWMLMICNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLLDTIAIAVAEGTDRIIGVIQRVCRAIRNIPTRIRQGFEASLL

SEQ ID NO: 55 - protein, 852 aa, Artificial Sequence
  Description of Artificial Sequence: Synthetic polypeptide
TRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVDNRTVGEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGEIRQAHCNISEEKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 56 - protein, 852 aa, Artificial Sequence
  Description of Artificial Sequence: Synthetic polypeptide
MRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYEQSAGGDMEITTHSFNCGGEFFYCTTSKLFNGTYNGTDISTNSSANSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 57 - protein, 852 aa, Artificial Sequence
  Description of Artificial Sequence: Synthetic polypeptide
TRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 58 - protein, 853 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSNATVKNRTVYEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYEQSAGGDMEITTHSFNCGGEFFYCNTSNLFNGTYNGTDISTNSSAKSNSTITLQCRIKQIINMWQGVGRAMYAPPIAGNITCKSNITGLLLTRDGGNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYMLLEDSQRQQERNEKDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 59 - protein, 852 aa, Artificial Sequence
  Description of Artificial Sequence: Synthetic polypeptide
MRVMGIPKNCPQWWIWGILGFWMLMICNGKGKLWVTIYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEEEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLREIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 60 - protein, 854 aa, Artificial Sequence
  Description of Artificial Sequence: Synthetic polypeptide
MRVTGILKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTVDEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEVIQGFCRAIRNIPRRIRQGFEASLL

SEQ ID NO: 61 - protein, 852 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVDNRTVGEMKNCSFNTTTEIRDKEKKEYALFYRPDIVPLSETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGEIKQAHCNISEEKWNETLQKVGKELQKHFPNKIIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGTNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTIAIAVAEGTDRIIEAIQGFCRAIRNIPTRIRQGFEASLL

SEQ ID NO: 62 - protein, 854 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQRFCRAIRNIPTRIRQGFEASLL

SEQ ID NO: 63 - protein, 849 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNAPVEIVCTRPNNDTRKSVRIGPGQTFYATGDIIGDIRQAHCNISEKEWNETLQKVGIELQKHFPNKTIKYEQSAGGDMEITTHSFNCGGEFFYCNTSKLFNGTYNGTYINTSSNSTITLQCRIKQIINMWQGVGRAMYAPPIAGNITCKSDITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 64 - protein, 852 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNSSKTEEETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 65 - protein, 852 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEEEWNDTLQKVGKELQKHFPNKTIEYKQSAGGDMEITTHSFNCGGEFFYCNTAKLFNGTYNGTDISTNSSTNSNPTITLQCRIKQIINMWQGVGRAMYAPPIAGNITCKSNITGLLLTRDGGNSSKTEEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQELLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLTARVVELLGRSSLRGLQRGWEVLKYLGSLVQYWGLELKKSAISLFDTIAIAVAEGTDRILEVIQRFCRAIRNIPTRIRQGFEASLL

SEQ ID NO: 66 - protein, 851 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDTRQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 67 - protein, 850 aa, Artificial Sequence
  Description of Artificial Sequence: Synthetic polypeptide
TRVMGILKNYPQWWIWGILGFWMLMNCNGEGNLWVTVYYGVPVWKEAKTTLFCASDAKAYKKEVHNVWATHACVPTDPSPQELFLDNVTENFNMWKNDMVDQMHEDIISLWDQSLKPCVKLTPLCVTLICSNATVENKTVEEMKNCSFNTTTEIRDKEKKEYALFYKPDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 68 - protein, 850 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 69 - protein, 851 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 70 - protein, 851 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQRSCRAIRNIPTRIRQGFEASLL

SEQ ID NO: 71 - protein, 851 aa, Artificial Sequence
  Description of Artificial Sequence: Synthetic polypeptide
TRVMGIPKNYPQWWIWGILGFWMLMICNGKGKLWVTVYYGVPVWKEAKTTLFCASDAKAYKKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFNTIAIAVAEGTDRILEVIQGFCRAIRNIPTRIRQGFEASLL

SEQ ID NO: 72 - protein, 850 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYKKEVHNVWATHACVPTDPSPQELFLKNVTENLNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIRQAHCNISEKQWNDTLQKVGKELQKHFPNKTIKYKHSAGGDMEITTHSFNCGGEFFYCNTSNLFNGTYNGTYMNISTDSNSTITLQCRIKQIINMWQGVGRAMYAPPIAGNITCKSHITGLLLTRDGGTNSSGKEEIFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLGGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 73 - protein, 853 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSTATVNKSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIVGDIRQAHCNISKGLWNDTLQKVGIELQKHFPNKTIKYNQSAGGDMEITTHSFNCGGEFFYCNTSNLFNGTYNGTYISTNSSANSTSYITLQCRIKQIINMWQGVGRAMYAPPIAGNITCRSNITGLLLTRDGGTTNNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 74 - protein, 852 aa, Artificial Sequence
  Description of Artificial Sequence: Synthetic polypeptide
TRVMGIPKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSTATVNKSTVEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEEEIVIRSENLTNNAKIIIVHLHTPVEIVCTRPNNNTRKSVRIGPGQTFYATGGIIGDVRQAHCNISKGLWNDTLQKVGKELQKHFPNKTIRYNQSAGGDMEITTHSFNCGGEFFYCNTAKLFNGTYNGTDISTNSSANNSSTITLQCRIKQIINMWQGVGRAMYAPPIAGNITCKSNITGLLLTRDGGINSSREEEIFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPTRIRQGFEASLL

SEQ ID NO: 75 - protein, 852 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNAIVENGTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGDPRQAHCNISKEKWNDTLQKVGKELQKHFPNKTIRYNQSAGGDMEITTHSFNCGGEFFYCNTAKLFNSTYNGTYISTNSTNSTSNITLQCRIKQIINMWQGVGRAMYAPPIAGNITCRSNITGLLLTRDGGTTNNSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAVAVAEGTDRIIEVIQGFCRAIRNIPRRIRQGFEASLL

SEQ ID NO: 76 - protein, 871 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVEIQPLGIAPTGAKRRVVGREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 77 - protein, 869 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPNPQEMFLKNVTENFNMWKNDMVDQMHEDIISLWDQSLKPCVKLTPLCVTLNCSNATVNSTTDYDSRSNDSVTNITNTIKEEVKNCSFKTTTEIRDKEKKEHALFYRPDIVPLNSETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVQLNTSVEIVCTRPGNNTRKSVRIGPGQTFYATGDIIGDIRQAHCNISEKKWNETLQRVGIELQKHFPNKTIKYNQSAGGDMEITTHSFNCGGEFFYCNTAKLFNSTYNGTYINTTSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPRRIRQGFEASLL

SEQ ID NO: 78 - protein, 871 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNSTTDYDSRSNDTVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSNVSTVQCTHGIRPVVSTQLLLNGSLAKEEIVIRSENLTNNAKTIIVHLHTPVEIVCTRPGNNTRKSMRIGPGQTFYATGDIIGDIRQAHCNISEEKWNKTLQEVGKELQKHFPNRTIKYNQSAGGDMEITTHSFNCGGEFFYCNTSKLFNSTYNDTYISTNSTNSSANNSSIITLQCRIKQIINMWQGVGRAMYAPPIAGNIICKSNITGLLLTRDGGPDSNKTETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPRRIRQGFEASLL

SEQ ID NO: 79 - protein, 850 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSHATVENSTTEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIIGEIRQAHCNISKETWNDTLQKVGKELQKHFPNKTIRYNQSAGGDMEITTHSFNCGGEFFYCNTAKLFNSTYNGTYISTNSTNSTSYITLQCRIKQIINMWQGVGRAMYAPPIAGNITCRSNITGLLLTRDGGTNSSEEEIFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRAIRNIPTRIRQGFEASLL

SEQ ID NO: 80 - protein, 852 aa, Artificial Sequence
  Description of Artificial Sequence: Synthetic polypeptide
MRVTGILKNYPQWWIWGILGFWMLMICNGEENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDKDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 81 - protein, 852 aa, Artificial Sequence
  Description of Artificial Sequence: Synthetic polypeptide
MRVMGIQKNYPRWWIWGILGFWMLMICNGEGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTTEEMKNCSFNTTTEIRDKEKKEHALFYRPDIVPLNNETGNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSKLFNSTYNGTYISTNSTNSTSYITLQCRIKQIINMWQGVGRAMYAPPIAGNITCRSNITGLLLTRDGGINNDSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTGTIYKLLEDSQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAVAVAEGTDRIIEVIQGFCRAIRNIPRRIRQGFEASLL

SEQ ID NO: 82 - protein, 853 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLICSNATVENSTTEEMKNCSFNTTTEIRDKEKKEHALFYRPDIVPLNNETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPNNNTRKSVRIGPGQTFYATGDIIGNIRQAHCNISESKWNDTLQKVGIELQKHFPNKTIKYNQSAGGDMEITTHSFNCGGEFFYCNTAKLFNSTYNGTYISTNSTNSTSKNITLQCRIKQIINMWQGVGRAMYAPPIAGNITCRSNITGLLLTRDGGTTNNSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSCLRGLQRGWEVLKYLGSLVQYWGLELKKSAISLFDTLAITVAEGTDRIIELIQGFCRAIRNIPRRIRQGFEASLL

SEQ ID NO: 83 - protein, 852 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPTRIRQGFEASLL

SEQ ID NO: 84 - protein, 852 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPRRIRQGFEASLL

SEQ ID NO: 85 - protein, 852 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNIWATHACVPTDPSPQELLLKNVTENFNMWKNDMVDQMHEDIISLWDQSLKPCVKLTPLCVTLICSNATVNQSTTEEMKNCSFNTTTEIRDKEKKEHALFYRPDIVPLDNETGNTSEYRLINCNTSAVTQACPKVTFEPIPIHYCAPAGYAILKCNDETFNGTGPCSKVSTVQCTHGIRPVVSTQLLLNGSLAEKGIVVRSENLTNNAKIIIVQLNASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPTRIRQGFEASLL

SEQ ID NO: 86 - protein, 867 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVRNSTTEKMSDALDRNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEEIVIRSENLTNNAKIIIVQLNANASVEIVCTRPNNNTRKSVRIGPGQTFYATGDIIGDIRQAHCNISEKKWNETLQQVGIELQKHFPNKTIKYNQSAGGDMEITTHSFNCGGEFFYCNTAKLFNSTYNGTYISTDSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVGREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWDNMTWMQWEREISNYTGTIYKLLEESQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDKSIRLVSGFLPIVWDDLRSLCLFSYHRLRDFLLLAARVVELLGRSSLRGLQRGWEVLKYLGSLVQYWGLELKKSAISLFDTLAIAVAEGTDRIIEAIQGFCRAIRNIPRRIRQGFEASLL

SEQ ID NO: 87 - protein, 867 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTTKLFNSTYNGTYISTNSINSTLNITLQCRIKQIINMWQGIGRAMYAPPIAGNITCRSNITGLLLTRDGGIHNDSNETETFRPAGGDMRDNWRSELYKYKVVEIQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWDNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSCLRGLQRGWEVLKYLGSLVQYWGLELKKSAISLFDTLAVAVAEGTDRIIEVIQGFCRAIRNIPRRIRQGFEASLL

SEQ ID NO: 88 - protein, 867 aa, Artificial Sequence
  Description of Artificial Sequence: Synthetic polypeptide
TRVMGIPKNYPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 89 - protein, 867 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWDNMTWMQWEREISNYTGTIYKLLEESQNQQERNEQDLLALDSWNSLWNWFNITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPRRIRQGFEASLL

SEQ ID NO: 90 - protein, 852 aa, Artificial Sequence
  Description of Artificial Sequence: Synthetic polypeptide
MRVTGIRKNCPQWWIWGILGFWMLMNCNGEGNLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLICSTATVNNSKFEEMKNCSFNTTTEIRDKEKKEYALFYRPDIVPLDNETSNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIKYNQSAGGDMEITTHSFNCGGEFFYCNTSNLFNSTYNDTYISTNSTNSTSYITLQCRIKQIINMWQGVGRAMYAPPIAGNITCKSNITGLLLTRDGGINKDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEVIQGFCRAIRNIPRRIRQGFEASLL

SEQ ID NO: 91 - protein, 851 aa, Artificial Sequence
  Description of Artificial Sequence: Synthetic polypeptide
MRVTGILKNYPRWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSIATANGSTVEEMKNCSFNTTTEIRDKEKKEYALFYRPDIVPLNNKTSNISEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIRYNQSAGGDMEITTHSFNCGGEFFYCNTSNLFNSTYNDTYISTNSSANNSSTITLQCRIKQIINMWQGVGRAMYAPPIAGNITCKSNITGLLLTRDGGTDSNETETFRPAGGDMRDNWRSELYKYKVVEIQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNNLWSWFSITKWLWYIKIFIMIVGGLIGLRIVFAVLSIVNRVRQGYSPLSLQTLTPNPRELDRLRGIEEEGGEQDRDKSIRLVDGFLPIVWDDLRSLCLFSYHRLRDFLLLAARVVELLGRSSLRGLQRGWEVLKYLGSLVQYWGLELKKSAISLFDTLAVAVAEGTDRIIEVIQGFCRAIRNIPRRIRQGFEASLL

SEQ ID NO: 92 - protein, 862 aa, Artificial Sequence
  Description of Artificial Sequence: Synthetic polypeptide
MRVTGILKNYPRWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTAKLFNSTYNDTYKSTNSSANNSSIITLQCRIKQIINMWQGVGRAMYAPPIAGNITCKSNITGLLLTRDGGINNVSNETETFRPAGGDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSCLRGLQRGWEVLKYLGSLVQYWGLELKKSAISLFDTLAVAVAEGTDRIIELIQGFCRAIRNIPRRIRQGFEASLL

SEQ ID NO: 93 - protein, 877 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSKVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGINNVSNETETFRPAGGDMRDNWRSELYKYKVVEVQPLGLAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEVIQGFCRAIRNIPRRIRQGFEASLL

SEQ ID NO: 94 - protein, 864 aa, Artificial Sequence
  Description of Artificial Sequence: Synthetic polypeptide
TRVMGILKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHTPVEIVCTRPYNNTRKSVRIGPGQTFYATGDIIGDPRQAHCNISKETWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGTTNNSNETETFRPAGGDMRDNWRSELYKYKVVEVQPLGLAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWGNMTWMQWEREISNYTGTIYKLLEDSQNQQERNEQDLLALDSWNNLWNWFSITKWLWYIKIFIMIVGGLIGLRIVFAVLSIVNRVRQGYSPLSLQTLTPNPREPDRLRRIEEEGGEQDRDRSIRLVNGFLPIVWDDLRSLCLFSYHRLRDFLLLAARVVELLGRSSLRGLQRGWEVLKYLGSLVQYWGLELKKSAISLFDTLAIAVAEGTDRIIELIQGFCRVIRNIPRRIRQGFEASLL

SEQ ID NO: 95 - protein, 864 aa, Artificial Sequence
  Description of Artificial Sequence: Synthetic polypeptide
MRVTGILRNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQNLLALDSWNSLWNWFSITKWLWYIKIFIMIVGGLIGLRIVFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLLDTIAIAVAEGTDRIIEAIQGFCRAIRNIPRRIRQGFEASLL

SEQ ID NO: 96 - protein, 856 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNNETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRKAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGPESNETETFRPAGGDMRDNWRSELYKYKVVEVQPLGIAPTGAKRRVVEREKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKRSTISLFDTLAIAVAEGTDRIIELIQGFCRAIRNIPTRIRQGFEASLL

SEQ ID NO: 97 - protein, 866 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKTIIVHLHAPVEIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLREIEEEGGEQDRDRSIRLVSGFLPIVWDDLRSLCLFSYHRLRDFLLLAARVVELLGHSSLRGLQRGWEVLKYLGSLVQYWGLELKRSTISLFDTLAIAVAEGTDRIIELIQGFCRAIRNIPTRIRQGFEASLL

SEQ ID NO: 98 - protein, 859 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLREIEEEGGEQDRDRSIRLVSGFLPIVWDDLRSLCLFSYHRLRDFLLLAARVVELLGHSSLRGLQRGWEVLKYLGSLVQYWGLELKRSTISLFDTLAIAVAEGTDRIIELIQGFCRAIRNIPTRIRQGFEASLL

SEQ ID NO: 99 - protein, 859 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVGNSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIKIFIMIVGGLIGLRIVFAVLSIVNRVRQGYSPLSLQTLTPNPREPDRLRGIEEEGGEQDRDRSIRLVSGFLPIVWDDLRSLCLFSYHRLRDFLLLAARVVELLGHSSLRGLQRGWEVLKYLGSLVQYWGLELKRSTISLFDTLAIAVAEGTDRIIELIQGFCRAIRNIPTRIRQGFEASLL

SEQ ID NO: 100 - protein, 865 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHAPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSIITLQCKIKQIINMWQGVGRAMYAPPIAGNITCKSNITGLLLTRDGGINNVSNETETFRPAGGDMRDNWRSELYKYKVVEVQPLGIAPTGAKRRVVEREKRAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWNNMTWMQWEREISNYTGTIYKLLEDSQNQQERNEKDLLALDSWNSLWSWFNITKWLWYIKIFIMIVGGLIGLRIVFAVLSIVNRVRQGYSPLSLQTLTPNPREPDRLRRIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIELIQGFCRAIRNIPRRIRQGFEASLL

SEQ ID NO: 101 - protein, 865 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEISNATVKNITIKEMKNCSFNTTTEIRDKIKKERALFYRTDIVPLNKETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRQAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGINNVSNETETFRPAGGDMRDNWRSELYKYKVVEVQPLGIAPTGAKRRVVERGKRAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIKIFIMIVGGLIGLRIIFAVLSIVNRVRQGYSPLSLQTLTPNPREPDRLRGIEEEGGEQDRDKSIRLVNGFLPIVWDDLRSLCLFSYHRLRDFLLLAARVVELLGRSSLRGLQRGWEVLKYLGSLVQYWGLELKKSAISLFDTLAVAVAEGTDRIIEAIQGFCRAIRNIPRRIRQGFEASLL

SEQ ID NO: 102 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 103 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 104 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWSKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 105 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASNAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 106 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGHITCKSNITGLLLTRDGGTKNNSNETEETFRPAGGDMRDNWRSELYKYKVVEIQPLGIAPTGAKRRVVEREKR

SEQ ID NO: 107 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 108 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 109 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 110 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTHSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 111 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 112 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 113 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 114 - protein, 514 aa, Artificial Sequence
  Description of Artificial Sequence: Synthetic polypeptide
MKVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSSITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 115 - protein, 514 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 116 - protein, 518 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 117 - protein, 518 aa, Artificial Sequence
  Description of Artificial Sequence: Synthetic polypeptide
MRVRGILKNYPQWWIWGILGFWMLMICNGKGKLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 118 - protein, 514 aa, Artificial Sequence
  Description of Artificial Sequence: Synthetic polypeptide
MRVMGIPKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNAIVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGARRRVVEREKR

SEQ ID NO: 119 - protein, 514 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELGLENVTENFNMWKNDMVDQMHEDIISLWDQSLKPCVKLTPLCVTLKCSNAIVDSSKVYDTRSKVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 120 - protein, 514 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 121 - protein, 514 aa, Artificial Sequence
  Description of Artificial Sequence: Synthetic polypeptide
MRVMGIPKNYPQWWIWGILGFWILMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCNSATVDNSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNDKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 122 - protein, 502 aa, Artificial Sequence
  Description of Artificial Sequence: Synthetic polypeptide
MRVMGIPKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 123 - protein, 514 aa, Artificial Sequence
  Description of Artificial Sequence: Synthetic polypeptide
MRVMGILKNYLQWWIWGILGFWMLMICKGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLTCSNATVDNSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWYKTLQEVGKELQKHFPNKTIKYERSAGGDMEIATHSFNCGGEFFYCNTSNLFNGTYNGTYISINSTSYITLQCRIKQIINMWQGVGRAMYAPPIAGNITCKSNITGLLLTRDGGTKNNSNETEETFRPAGGDMRDNWRSELYKYKVVEIQPLGIAPTGAKRRVVEREKR

SEQ ID NO: 124 - protein, 502 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQEVGKELQKHFPNKTIKYERSAGGDMEIATHSFNCGGEFFYCNTSNLFNGTYNGTDISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 125 - protein, 504 aa, Artificial Sequence
  Description of Artificial Sequence: Synthetic polypeptide
MKVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEGQWNKTLQEVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 126 - protein, 504 aa, Artificial Sequence
  Description of Artificial Sequence: Synthetic polypeptide
MRVMGILKNYPQWWIWGILGFWMLMNCNGKGNLWVTVYYGVPVWKEAKTTLFCASDAKAYKKEVHNVWATHACVPTDPSPQELVLENVTENFNMWKNDMVDQMHEDIISLWDQSLKPCVKLTPLCVTLNCSNARSNVNVTSINNTIMGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 127 - protein, 500 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLNCSNVSNVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEIATHSFNCGGEFFYCNTSNLFNGTYNGTYSTNSTSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 128 - protein, 501 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLDNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSKLFNGTYNGTYISTNSTSYITLQCRIKQIINMWQGVGRAMYAPPIAGNITCKSNITGLLLTRDGGTNNNSNEETFRPAGGDMRDNWRSELYKYKVVEIQPLGIAPTGAKRRVVEREKR

SEQ ID NO: 129 - protein, 505 aa, Artificial Sequence
  Description of Artificial Sequence: Synthetic polypeptide
MRVMGILKNYPPWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLNCSNVNVVNVTNITNTIKGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSNLFNGTYNGTYISTNSSANSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 130 - protein, 503 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLDCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSNLFNGTYNGTYINISTNSNSTITLQCRIKQIINMWQGVGRAMYAPPIAGNITCRSNITGLLLTRDGGTKNNSNEETFRPAGGDMRDNWRSELYKYKVVEIQPLGIAPTGAKRRVVEREKR

SEQ ID NO: 131 - protein, 496 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKR

SEQ ID NO: 132 - protein, 505 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGKYINISTNSNSTITLQCRIKQIINMWQGVGRAMYAPPIAGNITCKSNITGLLLTRDGGTKNNSTETEETFRPAGGDMRDNWRSELYKYKVVEIQPLGIAPTGAKRRVVEREKR

SEQ ID NO: 133 - protein, 503 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQEVGKELQKHFPNKTIKYERSAGGDMEITTHSFNCGGEFFYCNTSNLFNGTYNGPYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKRRVVEREKR

SEQ ID NO: 134 - protein, 514 aa, Artificial Sequence
  Description of Artificial Sequence: Synthetic polypeptide
MKVMGILKNYPQWWIWGILGFWMLMICKGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKRRVVEREKR

SEQ ID NO: 135 - protein, 509 aa, Artificial Sequence
  Description of Artificial Sequence: Synthetic polypeptide
TRVMGILKNYPQWWIWGILGFWMLMICNGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTRSNVNVTNITNTIKGEMKNCSFNTTTEIRDKEKKEYALFYRSDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLHEVSKELQKHFPNKTIKYAQSAGGDMEITTHSFNCGGEFFYCNTSNLFNGTYNGTYISTNSSANSNSTITLQCRIKQIINMWQGVGRAMYAPPIAGNITCRSNITGLLLTRDGGTKNNKTEETFRPAGGDMRDNWRSELYKYKVVEIQPLGIAPTGAKRRVVEREKR

SEQ ID NO: 136 - protein, 505 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKR

SEQ ID NO: 137 - protein, 512 aa, Artificial Sequence
  Description of Artificial Sequence: Synthetic polypeptide
MRVMGIPKNYPQWWIWGILGFWMLMICSGRGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLICSNATVNNRTVYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSKLFNGTYNGINISTNSNSTITLQCRIKQIINMWQGVGRAMYAPPIAGNITCKSNITGLLLTRDGGNRNNSNEETFRPAGGDMRDNWRSELYKYKVVEIQPLGIAPTGAKRRVVEREKR

SEQ ID NO: 138 - protein, 512 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTVYDTRSNANVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKR

SEQ ID NO: 139 - protein, 514 aa, Artificial Sequence
  Description of Artificial Sequence: Synthetic polypeptide
MRVMGILKNCPQWWIWGILGFWMLMICNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYDTRSNVSVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPSNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYTNISTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKRRVVEREKR

SEQ ID NO: 140 - protein, 496 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGAIIGDIRQAHCNISESKWNETLQKVGKELQKHFPNKTIKYEQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKR

SEQ ID NO: 141 - protein, 499 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSNATVNNRTVYEMKNCSFNTTTEIRDKEKKEYALFYRSDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGEIRQAHCNISESKWNETLQKVGKELQKHFPNKTIKYERSAGGDMEITTHSFNCGGEFFYCNTSKLFNGTYNGTDISTNSSANSNSTITLQCRIKQIINIWQGVGRAMYAPPIAGNITCKSNITGLLLTRDGGNNNNRNEETFRPAGGDMRDNWRSELYKYKVVEIQPLGIAPTGAKRRVVEREKR

SEQ ID NO: 142 - protein, 500 aa, Artificial Sequence
  Description of Artificial Sequence: Synthetic polypeptide
MRVTGILKNYPQWWIWGILGFWMLMTCNGEGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESEWNETLQKVGKELQKHFPNKTIKYEQSAGGDMEITTHSFNCGGEFFYCNTAELFNGTYNGTDISTNSSANSTSTITLQCRIKQIINMWQGVGRAMYAPPIAGNITCRSNITGLLLTRDGGINNVSNETETFRPAGGDMRDNWRSELYKYKVVEVQPLGIAPTGAKRRVVEREKR

SEQ ID NO: 143 - protein, 500 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGNELQKHFPNKTIKYEQAAGGDMEITTHSFNCGGEFFYCNTANLFNGTYNGTDISTNSSANSTSTITLQCKIKQIINMWQGVGRAMYAPPIAGNITCRSNITGLLLTRDGGINNVSNETETFRPAGGDMRDNWRSELYKYKVVEVQPLGIAPTGAKRRVVEREKR

SEQ ID NO: 144 - protein, 500 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVSLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHAPVEIVCTRPGHNTRKSVRIGPGQTFYATGDIIGNIRQAHCNINESEWNETLQKVGKELRKHFPNKTIKYEQSAGGDMEITTHSFNCGGEFFYCNTANLFNGTYNGTDISTNSSADRNSTITLECKIKQIINMWQGVGRAMYAPPIAGNITCRSNITGLLLTRDGGINNVSNATETFRPAGGDMRDNWRSELYKYKVVEVQPLGIAPTGAKRRVVEREKR

SEQ ID NO: 145 - protein, 496 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYEMKNCSFNTTTEIRDKEKKEYALFYRPDIVPLGETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKR

SEQ ID NO: 146 - protein, 496 aa, Artificial Sequence
  Description of Artificial Sequence: Synthetic polypeptide
MRVMGILKNCPQWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNKTFNGTGPCSKVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKRRVVEREKR

SEQ ID NO: 147 - protein, 497 aa, Artificial Sequence
  Description of Artificial Sequence: Synthetic polypeptide
MKVMGIPKNYPQWWIWGILGFWMLMNCNGKENLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSKLFNGTYNGTDISTNSSANSNSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKR

SEQ ID NO: 148 - protein, 518 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKRRVVEREKR

SEQ ID NO: 149 - protein, 497 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKR

SEQ ID NO: 150 - protein, 497 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNNRVDQMHEDIISLWDQSLKPCVKLTPLCVTLICSNATVDNRTVGEMKNCSFNTTTEIRDKEKKEYALFYKPDVVPLDETNNTSEYRLINCNTSAVTQACPKVTFEPIPIHYCAPAGYAILKCNNETFNRTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKR

SEQ ID NO: 151 - protein, 514 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERPAGGDLEITTHSFNCGGEFFYCNTSKLFNGTYNGTDISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKR

SEQ ID NO: 152 - protein, 516 aa, Artificial Sequence
  Description of Artificial Sequence: Synthetic polypeptide
TRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTDYDTRSNVNVTNITNTIKGEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNSSEEIFRPAGGDMRDNWRSELYKYKVVEIQPLGIAPTGAKRRVVEREKR

SEQ ID NO: 153 - protein, 518 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKRRVVEREKR

SEQ ID NO: 154 - protein, 499 aa, Artificial Sequence
  Description of Artificial Sequence: Synthetic polypeptide
MRVMGILKNYPQWWIWGILGFWMLMICNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKRRVVEREKR

SEQ ID NO: 155 - protein, 500 aa, Artificial Sequence
  Description of Artificial Sequence: Synthetic polypeptide
TRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVDNRTVGEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGEIRQAHCNISEEKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKR

SEQ ID NO: 156 - protein, 500 aa, Artificial Sequence
  Description of Artificial Sequence: Synthetic polypeptide
MRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYEQSAGGDMEITTHSFNCGGEFFYCTTSKLFNGTYNGTDISTNSSANSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKR

SEQ ID NO: 157 - protein, 500 aa, Artificial Sequence
  Description of Artificial Sequence: Synthetic polypeptide
TRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKRRVVEREKR

SEQ ID NO: 158 - protein, 501 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSNATVKNRTVYEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYEQSAGGDMEITTHSFNCGGEFFYCNTSNLFNGTYNGTDISTNSSAKSNSTITLQCRIKQIINMWQGVGRAMYAPPIAGNITCKSNITGLLLTRDGGNSSKTEEETFRPAGGDMRDNWRSELYKYKVVEIQPLGIAPTGAKRRVVEREKR

SEQ ID NO: 159 - protein, 500 aa, Artificial Sequence
  Description of Artificial Sequence: Synthetic polypeptide
MRVMGIPKNCPQWWIWGILGFWMLMICNGKGKLWVTIYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEEEEIFRPAGGDMRDNWRSELYKYKVVEIQPLGIAPTGAKRRVVEREKR

SEQ ID NO: 160 - protein, 502 aa, Artificial Sequence
  Description of Artificial Sequence: Synthetic polypeptide
MRVTGILKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTVDEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNNSSKTEEETFRPAGGDMRDNWRSELYKYKVVEIQPLGIAPTGAKRRVVEREKR

SEQ ID NO: 161 - protein, 500 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVDNRTVGEMKNCSFNTTTEIRDKEKKEYALFYRPDIVPLSETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGEIKQAHCNISEEKWNETLQKVGKELQKHFPNKIIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGTNSSKTEEETFRPAGGDMRDNWRSELYKYKVVEIQPLGIAPTGAKRRVVEREKR

SEQ ID NO: 162 - protein, 502 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKRRVVEREKR

SEQ ID NO: 163 - protein, 497 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNAPVEIVCTRPNNDTRKSVRIGPGQTFYATGDIIGDIRQAHCNISEKEWNETLQKVGIELQKHFPNKTIKYEQSAGGDMEITTHSFNCGGEFFYCNTSKLFNGTYNGTYINTSSNSTITLQCRIKQIINMWQGVGRAMYAPPIAGNITCKSDITGLLLTRDGGTNSSGKEEIFRPAGGDMRDNWRSELYKYKVVEIQPLGIAPTGAKRRVVEREKR

SEQ ID NO: 164 - protein, 500 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNSSKTEEETFRPAGGDMRDNWRSELYKYKVVEIQPLGIAPTGAKRRVVEREKR

SEQ ID NO: 165 - protein, 500 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEEEWNDTLQKVGKELQKHFPNKTIEYKQSAGGDMEITTHSFNCGGEFFYCNTAKLFNGTYNGTDISTNSSTNSNPTITLQCRIKQIINMWQGVGRAMYAPPIAGNITCKSNITGLLLTRDGGNSSKTEEEIFRPAGGDMRDNWRSELYKYKVVEIQPLGIAPTGAKRRVVEREKR

SEQ ID NO: 166 - protein, 499 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDTRQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKR

SEQ ID NO: 167 - protein, 498 aa, Artificial Sequence
  Description of Artificial Sequence: Synthetic polypeptide
TRVMGILKNYPQWWIWGILGFWMLMNCNGEGNLWVTVYYGVPVWKEAKTTLFCASDAKAYKKEVHNVWATHACVPTDPSPQELFLDNVTENFNMWKNDMVDQMHEDIISLWDQSLKPCVKLTPLCVTLICSNATVENKTVEEMKNCSFNTTTEIRDKEKKEYALFYKPDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKR

SEQ ID NO: 168 - protein, 498 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKRRVVEREKR

SEQ ID NO: 169 - protein, 499 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSGKEEIFRPAGGDMRDNWRSELYKYKVVEIQPLGIAPTGAKRRVVEREKR

SEQ ID NO: 170 - protein, 499 aa, Artificial Sequence
  Description of Artificial Sequence: Synthetic polypeptide
TRVMGILKNYPQWWIWGILGFWMLMICNGKGKLWVTVYYGVPVWKEAKTTLFCASDARAYEKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKRRVVEREKR

SEQ ID NO: 171 - protein, 499 aa, Artificial Sequence
  Description of Artificial Sequence: Synthetic polypeptide
TRVMGIPKNYPQWWIWGILGFWMLMICNGKGKLWVTVYYGVPVWKEAKTTLFCASDAKAYKKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKRRVVEREKR

SEQ ID NO: 172 - protein, 498 aa, Artificial Sequence
  Description of Artificial Sequence: Synthetic polypeptide
TRVMGILKNYPQWWIWGILGFWMLMICNGKGKLWVTVYYGVPVWKEAKTTLFCASDAKAYKKEVHNVWATHACVPTDPSPQELFLKNVTENLNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIRQAHCNISEKQWNDTLQKVGKELQKHFPNKTIKYKHSAGGDMEITTHSFNCGGEFFYCNTSNLFNGTYNGTYMNISTDSNSTITLQCRIKQIINMWQGVGRAMYAPPIAGNITCKSHITGLLLTRDGGTNSSGKEEIFRPAGGDMRDNWRSELYKYKVVEIQPLGIAPTGAKRRVVEREKR

SEQ ID NO: 173 - protein, 501 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSTATVNKSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIVGDIRQAHCNISKGLWNDTLQKVGIELQKHFPNKTIKYNQSAGGDMEITTHSFNCGGEFFYCNTSNLFNGTYNGTYISTNSSANSTSYITLQCRIKQIINMWQGVGRAMYAPPIAGNITCRSNITGLLLTRDGGTTNNSNETETFRPAGGDMRDNWRSELYKYKVVEIQPLGIAPTGAKRRVVEREKR

SEQ ID NO: 174 - protein, 500 aa, Artificial Sequence
  Description of Artificial Sequence: Synthetic polypeptide
TRVMGIPKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSTATVNKSTVEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEEEIVIRSENLTNNAKIIIVHLHTPVEIVCTRPNNNTRKSVRIGPGQTFYATGGIIGDVRQAHCNISKGLWNDTLQKVGKELQKHFPNKTIRYNQSAGGDMEITTHSFNCGGEFFYCNTAKLFNGTYNGTDISTNSSANNSSTITLQCRIKQIINMWQGVGRAMYAPPIAGNITCKSNITGLLLTRDGGINSSREEEIFRPAGGDMRDNWRSELYKYKVVEVQPLGIAPTGAKRRVVEREKR

SEQ ID NO: 175 - protein, 500 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNAIVENGTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGDPRQAHCNISKEKWNDTLQKVGKELQKHFPNKTIRYNQSAGGDMEITTHSFNCGGEFFYCNTAKLFNSTYNGTYISTNSTNSTSNITLQCRIKQIINMWQGVGRAMYAPPIAGNITCRSNITGLLLTRDGGTTNNSNETETFRPAGGDMRDNWRSELYKYKVVEIQPLGIAPTGAKRRVVEREKR

SEQ ID NO: 176 - protein, 519 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVEIQPLGIAPTGAKRRVVGREKR

SEQ ID NO: 177 - protein, 517 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPNPQEMFLKNVTENFNMWKNDMVDQMHEDIISLWDQSLKPCVKLTPLCVTLNCSNATVNSTTDYDSRSNDSVTNITNTIKEEVKNCSFKTTTEIRDKEKKEHALFYRPDIVPLNSETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVQLNTSVEIVCTRPGNNTRKSVRIGPGQTFYATGDIIGDIRQAHCNISEKKWNETLQRVGIELQKHFPNKTIKYNQSAGGDMEITTHSFNCGGEFFYCNTAKLFNSTYNGTYINTTSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKR

SEQ ID NO: 178 - protein, 519 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNSTTDYDSRSNDTVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSNVSTVQCTHGIRPVVSTQLLLNGSLAKEEIVIRSENLTNNAKTIIVHLHTPVEIVCTRPGNNTRKSMRIGPGQTFYATGDIIGDIRQAHCNISEEKWNKTLQEVGKELQKHFPNRTIKYNQSAGGDMEITTHSFNCGGEFFYCNTSKLFNSTYNDTYISTNSTNSSANNSSIITLQCRIKQIINMWQGVGRAMYAPPIAGNIICKSNITGLLLTRDGGPDSNKTETFRPAGGDMRDNWRSELYKYKVVEVQPLGIAPTGAKRRVVEREKR

SEQ ID NO: 179 - protein, 498 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSHATVENSTTEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIIGEIRQAHCNISKETWNDTLQKVGKELQKHFPNKTIRYNQSAGGDMEITTHSFNCGGEFFYCNTAKLFNSTYNGTYISTNSTNSTSYITLQCRIKQIINMWQGVGRAMYAPPIAGNITCRSNITGLLLTRDGGTNSSEEEIFRPAGGDMRDNWRSELYKYKVVEVQPLGIAPTGAKRRVVEREKR

SEQ ID NO: 180 - protein, 500 aa, Artificial Sequence
  Description of Artificial Sequence: Synthetic polypeptide
MRVTGILKNYPQWWIWGILGFWMLMICNGEENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKRRVVEREKR

SEQ ID NO: 181 - protein, 500 aa, Artificial Sequence
  Description of Artificial Sequence: Synthetic polypeptide
MRVMGIQKNYPRWWIWGILGFWMLMICNGEGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTTEEMKNCSFNTTTEIRDKEKKEHALFYRPDIVPLNNETGNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSKLFNSTYNGTYISTNSTNSTSYITLQCRIKQIINMWQGVGRAMYAPPIAGNITCRSNITGLLLTRDGGINNDSNETETFRPAGGDMRDNWRSELYKYKVVEIQPLGIAPTGAKRRVVEREKR

SEQ ID NO: 182 - protein, 501 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLICSNATVENSTTEEMKNCSFNTTTEIRDKEKKEHALFYRPDIVPLNNETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPNNNTRKSVRIGPGQTFYATGDIIGNIRQAHCNISESKWNDTLQKVGIELQKHFPNKTIKYNQSAGGDMEITTHSFNCGGEFFYCNTAKLFNSTYNGTYISTNSTNSTSKNITLQCRIKQIINMWQGVGRAMYAPPIAGNITCRSNITGLLLTRDGGTTNNSNETETFRPAGGDMRDNWRSELYKYKVVEVQPLGIAPTGAKRRVVEREKR

SEQ ID NO: 183 - protein, 500 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKR

SEQ ID NO: 184 - protein, 500 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKRRVVEREKR

SEQ ID NO: 185 - protein, 500 aa, Artificial Sequence
  Description of Artificial Sequence: Synthetic polypeptide
TRVMGIPKNYPRWWIWGILGFWMLMICNGKGKLWVTVYYGVPVWKEAKTTLFCASDAKAYVKEVHNIWATHACVPTDPSPQELLLKNVTENFNMWKNDMVDQMHEDIISLWDQSLKPCVKLTPLCVTLICSNATVNQSTTEEMKNCSFNTTTEIRDKEKKEHALFYRPDIVPLDNETGNTSEYRLINCNTSAVTQACPKVTFEPIPIHYCAPAGYAILKCNDETFNGTGPCSKVSTVQCTHGIRPVVSTQLLLNGSLAEKGIVVRSENLTNNAKIIIVQLNASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKRRVVEREKR

SEQ ID NO: 186 - protein, 515 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVRNSTTEKMSDALDRNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEEIVIRSENLTNNAKIIIVQLNANASVEIVCTRPNNNTRKSVRIGPGQTFYATGDIIGDIRQAHCNISEKKWNETLQQVGIELQKHFPNKTIKYNQSAGGDMEITTHSFNCGGEFFYCNTAKLFNSTYNGTYISTDSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVGREKR

SEQ ID NO: 187 - protein, 515 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTTKLFNSTYNGTYISTNSINSTLNITLQCRIKQIINMWQGIGRAMYAPPIAGNITCRSNITGLLLTRDGGIHNDSNETETFRPAGGDMRDNWRSELYKYKVVEIQPLGIAPTGAKRRVVERGKR

SEQ ID NO: 188 - protein, 515 aa, Artificial Sequence
  Description of Artificial Sequence: Synthetic polypeptide
TRVMGIPKNYPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKRRVVERGKR

SEQ ID NO: 189 - protein, 515 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKRRVVEREKR

SEQ ID NO: 190 - protein, 500 aa, Artificial Sequence
  Description of Artificial Sequence: Synthetic polypeptide
MRVTGIRKNCPQWWIWGILGFWMLMNCNGEGNLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLICSTATVNNSKFEEMKNCSFNTTTEIRDKEKKEYALFYRPDIVPLDNETSNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIKYNQSAGGDMEITTHSFNCGGEFFYCNTSNLFNSTYNDTYISTNSTNSTSYITLQCRIKQIINMWQGVGRAMYAPPIAGNITCKSNITGLLLTRDGGINKDSNETETFRPAGGDMRDNWRSELYKYKVVEVQPLGIAPTGAKRRVVEREKR

SEQ ID NO: 191 - protein, 499 aa, Artificial Sequence
  Description of Artificial Sequence: Synthetic polypeptide
MRVTGILKNYPRWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSIATANGSTVEEMKNCSFNTTTEIRDKEKKEYALFYRPDIVPLNNKTSNISEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIRYNQSAGGDMEITTHSFNCGGEFFYCNTSNLFNSTYNDTYISTNSSANNSSTITLQCRIKQIINMWQGVGRAMYAPPIAGNITCKSNITGLLLTRDGGTDSNETETFRPAGGDMRDNWRSELYKYKVVEIQPLGIAPTGAKRRVVEREKR

SEQ ID NO: 192 - protein, 510 aa, Artificial Sequence
  Description of Artificial Sequence: Synthetic polypeptide
MRVTGILKNYPRWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTAKLFNSTYNDTYKSTNSSANNSSIITLQCRIKQIINMWQGVGRAMYAPPIAGNITCKSNITGLLLTRDGGINNVSNETETFRPAGGDNWRSELYKYKVVEVQPLGIAPTGAKRRVVEREKR

SEQ ID NO: 193 - protein, 525 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSKVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGINNVSNETETFRPAGGDMRDNWRSELYKYKVVEVQPLGLAPTGAKRRVVEREKR

SEQ ID NO: 194 - protein, 512 aa, Artificial Sequence
  Description of Artificial Sequence: Synthetic polypeptide
TRVMGILKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHTPVEIVCTRPYNNTRKSVRIGPGQTFYATGDIIGDPRQAHCNISKETWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGTTNNSNETETFRPAGGDMRDNWRSELYKYKVVEVQPLGLAPTGAKRRVVEREKR

SEQ ID NO: 195 - protein, 512 aa, Artificial Sequence
  Description of Artificial Sequence: Synthetic polypeptide
MRVTGILRNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKRRVVEREKR

SEQ ID NO: 196 - protein, 504 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNNETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRKAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGPESNETETFRPAGGDMRDNWRSELYKYKVVEVQPLGIAPTGAKRRVVEREKR

SEQ ID NO: 197 - protein, 514 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKTIIVHLHAPVEIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKR

SEQ ID NO: 198 - protein, 507 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKR

SEQ ID NO: 199 - protein, 507 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVGNSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKRRVVEREKR

SEQ ID NO: 200 - protein, 513 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHAPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSIITLQCKIKQIINMWQGVGRAMYAPPIAGNITCKSNITGLLLTRDGGINNVSNETETFRPAGGDMRDNWRSELYKYKVVEVQPLGIAPTGAKRRVVEREKR

SEQ ID NO: 201 - protein, 513 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEISNATVKNITIKEMKNCSFNTTTEIRDKIKKERALFYRTDIVPLNKETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRQAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGINNVSNETETFRPAGGDMRDNWRSELYKYKVVEVQPLGIAPTGAKRRVVERGKR

SEQ ID NO: 202 - DNA, 2622 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgcactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggctgttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaagggatcc

SEQ ID NO: 203 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcgaacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtgaccgaattcgggacccggatcc

SEQ ID NO: 204 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtcaccgaattcgggacccggatcc

SEQ ID NO: 205 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtaaccgaattcgggacccggatcc

SEQ ID NO: 206 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtccaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggttaccgaattcgggacccggatcc

SEQ ID NO: 207 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgagaggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtgaccgaattcgggtcccggatcc

SEQ ID NO: 208 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcggcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaagtgcagcaacgccatcgtggactccagcaaggtgtacgacacgaggtccaaggtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacctcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctgggacaccaactggtccaacaagtcggagaaggacatctgggacaacatgacctggatgcagtgggagcgcgagatctccaactacaccgagaccatctacaagctcctcgaggactcccagcaccagcaggagcggaacgagcaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcaacaccatcgccatcgccgtggcggagggcaccgaccgcatcatcgagggcatccagcggttctgccgcgccatccgcaacatccccacccgcatccgccagggcttcgaggcctcgctcctgtagtaaggtgaccgaattcaggacccggatcc

SEQ ID NO: 209 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtgaccgaattcaggtcccggatcc

SEQ ID NO: 210 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggccacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggtcatccagcggttctgccgcgccatccgcaacatccccacccgcatccgccagggcttcgaggcctcgctcctgtagtaaggtgaccgaattcgggacctggatcc

SEQ ID NO: 211 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtgaccgaattcgggtcctggatcc

SEQ ID NO: 212 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtcaccgaattcgggtcccggatcc

SEQ ID NO: 213 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggccgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtcaccgaattcaggacccggatcc

SEQ ID NO: 214 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggagatccagcggttctgccgcgccatccgcaacatccccacccgcatccgccagggcttcgaggcctcgctcctgtagtaaggtcaccgaattcaggtcccggatcc

SEQ ID NO: 215 - DNA, 2653 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtccgacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactcctcgaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacgcctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtcaccgaattcgggacctggatcc

SEQ ID NO: 216 - DNA, 2641 bp, Artificial Sequence
  Description of Artificial Sequence: Synthetic polynucleotide
gtcgacaagaaatgaaggtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagctcgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgacgtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtcaccgaattcgggtcctggatcc

SEQ ID NO: 217 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacaactcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtaaccgaattcgggtcccggatcc

SEQ ID NO: 218 - DNA, 2641 bp, Artificial Sequence
  Description of Artificial Sequence: Synthetic polynucleotide
gtcgacaagaaatgcgcgtgatgggcatcccgaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccatcgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggcccgcaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccatctgggggatcaagcagctgcaggccagggtgctcgcgctcgagcgctacctgaaggaccagcagctgctcggcatgtggggctgctccggcaagctgatctgcaccaccgcggtgccctggaacacgtcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtaaccgaattcaggacccggatcc

SEQ ID NO: 219 - DNA, 2641 bp, Artificial Sequence
  Description of Artificial Sequence: Synthetic polynucleotide
gtcgacaagaaatgcgcgtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaactcgtcctggtccaacaagtcggagaaggacatctgggacaacatgacctggatgcagtgggagcgcgagatctccaactacaccgagaccatctacaagctcctcgaggactcccagcaccagcaggagcggaacgagcaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagctgatccagcggttctgccgcgccatccgcaacatccccacccgcatccgccagggcttcgaggcctcgctcctgtagtaaggtaaccgaattcaggtcccggatcc

SEQ ID NO: 220 - DNA, 2641 bp, Artificial Sequence
  Description of Artificial Sequence: Synthetic polynucleotide
gtcgacaagaaatgcgcgtgatgggcatccccaagaactacccgcagtggtggatctggggcatcctgggcttctggatactcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcaacagcgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagggccagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtaaccgaattcgggacctggatcc

SEQ ID NO: 221 - DNA, 2653 bp, Artificial Sequence
  Description of Artificial Sequence: Synthetic polynucleotide
gtcgacaagaaatgcgcgtgcggggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagcgccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgacgaactcctccaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacgcgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatccggatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgagggcatccagcggttctgccgcgccatccgcaacatccccacccgcatccgccagggcttcgaggcctcgctcctgtagtaaggtaaccgaattcgggtcctggatcc

SEQ ID NO: 222 - DNA, 2641 bp, Artificial Sequence
  Description of Artificial Sequence: Synthetic polynucleotide
gtcgacaagaaatgcgcgtgatgggcatcctcaagaactacctgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgacctgcagcaacgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgatcaactccacgagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctcgaggtgatccagcggttctgccgcgccatccgcaacatccccacccgcatccgccagggcttcgaggcctcgctcctgtagtaaggttaccgaattcgggtcccggatcc

SEQ ID NO: 223 - DNA, 2611 bp, Artificial Sequence
  Description of Artificial Sequence: Synthetic polynucleotide
gtcgacaagaaatgaaggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtggcctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgcgccggtcctccctgcggggcctgcagcgcggctgggaggtgctcaagtacctgggctcgctggtgcagtactggggcctggagctgaagaagtccgccatctccctgctcgacaccatcgccatcgccgtggcggagggcaccgaccgcatcatcgaagtgatccagcggtcgtgccgcgccatccgcaacatccccacccgcatccgccagggcttcgaggcctcgctcctgtagtaaggttaccgaattcaggacccggatcc

SEQ ID NO: 224 - DNA, 2605 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcctccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcaacaccatcgccatcgccgtggcggagggcaccgaccgcatcatcaaagtgatccagcggttctgccgcgccatccgcaacatccccacccgcatccgccagggcttcgaggcctcgctcctgtagtaaggttaccgaattcaggtcccggatcc

SEQ ID NO: 225 - DNA, 2611 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtggcctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgctcgacaccatcgccatcgccgtggcggagggcaccgaccgcatcatcgaagtgatccagcggtcgtgccgcgccatccgcaacatccccacccgcatccgccagggcttcgaggcctcgctcctgtagtaaggttaccgaattcgggacctggatcc

SEQ ID NO: 226 - DNA, 2605 bp, Artificial Sequence
  Description of Artificial Sequence: Synthetic polynucleotide
gtcgacaagaaatgcgggtgatgggcatcctcaagaactacccgcgctggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcaccgacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacgcctcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcaacaccatcgccatcgccgtggcggagggcaccgaccgcatcatcgagggcatccagcggttctgccgcgccatccgcaacatccccacccgcatccgccagggcttcgaggcctcgctcctgtagtaaggttaccgaattcgggtcctggatcc

SEQ ID NO: 227 - DNA, 2602 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtcgaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcacctacatctccaccaactccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaacaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgccgtggcgtggaacacctcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgctcgacaccatcgccatcgccgtggcggagggcaccgaccgcatcatcgaagtgatccagggcttctgccgcgccatccgcaacatccccacccgcatccgccagggcttcgaggcctcgctcctgtagtaagggacccgaattcggtgaccggatcc

SEQ ID NO: 228 - DNA, 2608 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcccgtacatcaacatctccaccaactccaacagcaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgccgtggcgtggaacacctcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagtgatccagggcttctgccgcgccatccgcaacatccccacccgcatccgccagggcttcgaggcctcgctcctgtagtaagggacccgaattcggtcaccggatcc

SEQ ID NO: 229 - DNA, 2608 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctggactgctcgaacgtgaacgtcgtgaacgtcacgaacatcaccaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccgtggaactcctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaagtggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgagatcatccagggcttctgccgcgccatccgcaacatccccacccgcatccgccagggcttcgaggcctcgctcctgtagtaagggacccgaattcggtaaccggatcc

SEQ ID NO: 230 - DNA, 2599 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgtccaacgtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctactccaccaactccaccagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaacaccgcggtggcctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgaagtgatccagggcttctgccgcgccatccgcaacatccccacccgcatccgccagggcttcgaggcctcgctcctgtagtaagggacccgaattcggttaccggatcc

SEQ ID NO: 231 - DNA, 2614 bp, Artificial Sequence
  Description of Artificial Sequence: Synthetic polynucleotide
gtcgacaagaaatgcgggtgatgggcatcctcaagaactacccgccgtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgaacgtggtgaacgtcacgaacatcacgaacacgatcaagggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgaccaactcgtccgcgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgcggtggcctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgctcgacaccatcgccatcgccgtggcggagggcaccgaccgcatcatcgaagtgatccagggcttctgccgcgccatccgcaacatccccacccgcatccgccagggcttcgaggcctcgctcctgtagtaagggtcccgaattcggtgaccggatcc

SEQ ID NO: 232 - DNA, 2642 bp, Artificial Sequence
  Description of Artificial Sequence: Synthetic polynucleotide
gtcgacaagaaatgaaggtgatgggcatcctcaagaactacccgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgcctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcaccgacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcaaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaagtgatccagcggttctgccgcgccatccgcaacatccccacccgcatccgccagggcttcgaggcctcgctcctgtagtaagaggacccgaattcggtgaccggatcc

SEQ ID NO: 233 - DNA, 2615 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtgaccgggtccaacgtgaacgtcacgaacatcacgaacacgatcaccggcgagatgaagaactgctccttcaacacgacgacggagatccgcgacaaggagaagaaggagtacgccctgttctacaagcccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcggcatcatcggcgacatccgccaggcccactgcaacatcagcgagtcgaagtggaacgagaccctgcacgaggtgtccaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaagtgatccagcggttctgccgcgccatccgcaacatccccacccgcatccgccagggcttcgaggcctcgctcctgtagtaagaggtcccgaattcggtgaccggatcc

SEQ ID NO: 234 - DNA, 2614 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtggtgaacgtcacgaacatcacgaacacgatcaagggcgagatgaagaactgctccttcaacacgacgacggagatccgcgacaaggagaagaaggagtacgccctgttctaccgccccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcaagtacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaactcgacggagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgcgcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaagtgatccagcggttctgccgcgccatccgcaacatccccacccgcatccgccagggcttcgaggcctcgctcctgtagtaagggacctgaattcggtgaccggatcc

SEQ ID NO: 235 - DNA, 2641 bp, Artificial Sequence
  Description of Artificial Sequence: Synthetic polynucleotide
gtcgacaagaaatgcgggtgatgggcatcctcaagaactgcccgcagtggtggatctggggcatcctgggcttctggatgctcatgatctgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctcgaacgtgtccgtcacgtccatcaacaacacgatcatgggcgagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgtccaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaccaacatctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatctgcctgcgcatcgtgttcgccgtgctgtcgatcgtgaaccgcgtgcgccagggctactccccgctgtccctgcaaacgctgacccccaacccccgggagccggacaggctgggcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagtgatccaggggttctgccgcgccatccgcaacatccccacccgcatccgccagggcttcgaggcctcgctcctgtagtaagggtcctgaattcggtgaccggatcc

SEQ ID NO: 236 - DNA, 2590 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcgtgaacgtcacgaacatcacgaacacgatcaagggcgagatgaagaactgctccttcaacacgacgacggagatccgcgacaaggagaagaaggagtacgccctgttctaccgccccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccggggaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaacggctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctcgaagtgatccagcgcttctgccgcgccatccgcaacatccccacccgcatccgccagggcttcgaggcctcgctcctgtagtaagggtcccgaattcggtcaccggatcc

SEQ ID NO: 237 - DNA, 2636 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgcgaacgtcacgtccatcaacaacacgatcatgggcgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggaccaactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccacggtggcgtggaacacgtcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaagtgatccaggggttctgccgcgccatccgcaacatccccacccgcatccgccagggcttcgaggcctcgctcctgtagtaagaggacccgaattcggtcaccggatcc

SEQ ID NO: 238 - DNA, 2636 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgatctgctcgggccgcgggaacctctgggtgacggtgtactacggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaagctgttcaacggcacctacaacgggatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaaccggaacaacagcaacgaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaagtgatccagcggttctgccgcgccatccgcaacatccccacccgcatccgccagggcttcgaggcctcgctcctgtagtaagaggtcccgaattcggtcaccggatcc

SEQ ID NO: 239 - DNA, 2587 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgggcgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgtcgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgaagtgatccagggcttctgccgcgccatccgcaacatccccacccgcatccgccagggcttcgaggcctcgctcctgtagtaagggacctgaattcggtcaccggatcc

SEQ ID NO: 240 - DNA, 2587 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggggaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccatgggcgagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtgatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgcgatcatcggcgacatccgccaggcccactgcaacatcagcgagtccaagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctcgaagtgatccagcgcttctgccgcgccatccgcaacatccccacccgcatccgccagggcttcgaggcctcgctcctgtagtaagggtcctgaattcggtcaccggatcc

SEQ ID NO: 241 - DNA, 2590 bp, Artificial Sequence
  Description of Artificial Sequence: Synthetic polynucleotide
gtcgacaagaaatgaaggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagaggtcggccggcggcgacatggagatcaccacgcactccttcaactgcggtggcgagttcttctactgcaacacgtcgaagctgttcaacggcacgtacaacgggaccgacatctccacgaactcgtccgcgaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgcggtggcctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcaaagtgatccagggcttctgccgcgccatccgcaacatccccacccgcatccgccagggcttcgaggcctcgctcctgtagtaagggtcccgaattcggtaaccggatcc

SEQ ID NO: 242 - DNA, 2588 bp, Artificial Sequence
  Description of Artificial Sequence: Synthetic polynucleotide
gtcgacaagaaatgcgggtgatgggcatcctcaagaactgcccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgcgtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgaaggcatccagcgcttctgccgcgccatccgcaacatccccacccgcatccgccagggcttcgaggcctcgctcctgtagtaagaggacccgaattcggtaaccggatcc

SEQ ID NO: 243 - DNA, 2591 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacaaccgggtggaccagatgcacgaggacatcatctccctgtgggaccagtccctgaagccctgcgtgaagctgaccccgctgtgcgtgaccctgatctgctcgaacgccacggtggacaaccgcaccgtcggggagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaaccggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcggcatcatcggcgacatccgccaggcccactgcaacatcagcgaggggcagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacggcacgtacaacggcacctacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtgggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgagctcatccagcggtcgtgccgcgccatccgcaacatccccacccgcatccgccagggcttcgaggcctcgctcctgtagtaagaggtcccgaattcggtaaccggatcc

SEQ ID NO: 244 - DNA, 2641 bp, Artificial Sequence
  Description of Artificial Sequence: Synthetic polynucleotide
gtcgacaagaaatgcgggtgacgggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcgccccgccggcggcgacctggagatcaccacgcactccttcaactgcggtggcgagttcttctactgcaacacgtcgaagctgttcaacggcacgtacaacggcaccgacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagaaggatctgctcgcgctggactcgtggaactccctgtggaactggttcaacatcaccaagtggctgtggtacatcaagatcttcatcatcatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaggtcatccagcggttctgccgcgccatccgcaacatccccacccgcatccgccagggcttcgaggcctcgctcctgtagtaagggacctgaattcggtaaccggatcc

SEQ ID NO: 245 - DNA, 2653 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaacggcaaggggaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcgcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaccagcaacgaggagacgttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgccgtgccctgggactcgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaactggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgggtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcctggaggtcatccagggcttctgccgcgccatccgcaacatccccacccgcatccgccagggcttcgaggcctcgctcctgtagtaagggtcctgaattcggtaaccggatcc

SEQ ID NO: 246 - DNA, 2596 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaagggcaaggggaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccgctcggacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgagatccgccaggcccactgcaacatcagcgagtcgaagtggaacgagaccctgcagaaggtgggcaaggagctgcagaagcacttccccaacaagacgattaagtacgagcgctcggccggcggcgacatggagatcaccacgcactccttcaactgcggtggcgagttcttctactgcaacacgtcgaagctgttcaacggcacgtacaacggcaccgacatctccacgaactcgtccgccaactcgaacagcacgatcacgctccagtgccgcatcaagcagatcatcaacatctggcagggggtgggccgcgctatgtacgcaccgcccatcgccggcaacatcacctgcaagtccaacatcaccggcctcctgctgacccgcgacggcggcaacaacaacaaccggaacgaggagacgttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgtggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctggccatcgccgtggcggagggcaccgaccgcatcatcgaggtcatccagggcttctgccgcgccatccgcaacatccccacccgcatccgccagggcttcgaggcctcgctcctgtagtaagggtcccgaattcggttaccggatcc

SEQ ID NO: 247 - DNA, 2600 bp, Artificial Sequence
  Description of Artificial Sequence: Synthetic polynucleotide
gtcgacaagaaatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggacaaccgcaccgtcggcgagatgaagaactgctccttcaacacgacgacggagatccgcgacaaggagaagaaggagtacgccctgttctaccgcccggacatcgtgccgctgtccgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgagatcaagcaggcccactgcaacatcagcgaggagaagtggaacgagaccctgcagaaggtgggcaaggagctgcagaagcacttccccaacaagatcattaagtacgcccagtcggccggcggcgacatggagatcaccacgcactccttcaactgcggtggcgagttcttctactgcaacacggcgaacctgttcaacggcacgtacaacggcaccgacatctccacgaactcgtccaccaagtcgaacagcacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcgaagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgggcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccatcgccatcgccgtggcggagggcaccgaccgcatcatcgaggcgatccagggcttctgccgcgccatccgcaacatccccacccgcatccgccagggcttcgaggcctcgctcctgtagtaagaggacccgaattcggttaccggatcc

SEQ ID NO: 248 - DNA, 2597 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgatctgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacgtccaacctgttcaacggcacgtacaacggcacctacatgaacatctccaccgactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgctcgacaccatcgccatcgccgtggcggagggcaccgaccgcatcatcggggtcatccagcgggtgtgccgcgccatccgcaacatccccacccgcatccgccagggcttcgaggcctcgctcctgtagtaagaggtcccgaattcggttaccggatcc

SEQ ID NO: 249 - DNA, 2599 bp, Artificial Sequence
  Description of Artificial Sequence: Synthetic polynucleotide
gtcgacaagaaatgcgggtgatgggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagtccaagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaccacgtccaagctgttcaacgggacgtacaacggcacggacatctccacgaactcctcggcgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcgggaaggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgggcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgagctcatccaggggttctgccgcgccatccgcaacatccccacccgcatccgccagggcttcgaggcctcgctcctgtagtaagggacctgaattcggttaccggatcc

SEQ ID NO: 250 - DNA, 2605 bp, Artificial Sequence
  Description of Artificial Sequence: Synthetic polynucleotide
gtcgacaagaaatgcgcgtgaccggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggccaacctgttcaacgggacgtacaacggcacggacatctccacgaactcctcgacgaagtcgaactcgacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcaacaactcgagcaagacggaggaggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcgaagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcggcatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagtgatccaggggttctgccgcgccatccgcaacatcccccgccgcatccgccagggcttcgaggcctcgctcctgtagtaagggtcctgaattcggttaccggatcc

SEQ ID NO: 251 - DNA, 2599 bp, Artificial Sequence
  Description of Artificial Sequence: Synthetic polynucleotide
gtcgacaagaaatgcgcgtgatgggcatccccaagaactgcccgcagtggtggatctggggcatcctgggcttctggatgctcatgatctgcaacggcaaggggaagctctgggtgacgatctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacggccaagctgttcaacgggacgtacaacggcacggacatctccacgaactcctcggcggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcaccaactcgagcgaggaggaggagatcttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgagatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaagaattcggtgaccgggacccggatcc

SEQ ID NO: 252 - DNA, 2596 bp, Artificial Sequence
  Description of Artificial Sequence: Synthetic polynucleotide
gtcgacaagaaatgcgcgtgacgggcatcctcaagaactacccgcagtggtggatctggggcatcctgggcttctggatgctcatgaactgcaacggcaaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacacgcggcaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaagaattcggtcaccgggacccggatcc

SEQ ID NO: 253 - DNA, 2593 bp, Artificial Sequence
  Description of Artificial Sequence: Synthetic polynucleotide
gtcgacaagaaatgcgcgtgacgggcatcctcaagaactacccgcagtggtggatctggggcatcctgggcttctggatgctcatgaactgcaacggcaaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgcacgccacggtggagaactccacgaccgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcggcatcatcggcgagatccggcaggcccactgcaacatcagcaaggagacctggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggccaagctgttcaactcgacgtacaacggcacctacatctccacgaactccacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgtcggaggaggagatcttcaggccagcgggaggcgacatgcgcgacaactggcgctccgagctgtacaagtacaaggtggtggaggtgcagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaagaattcggtaaccgggacccggatcc

SEQ ID NO: 254 - DNA, 2599 bp, Artificial Sequence
  Description of Artificial Sequence: Synthetic polynucleotide
gtcgacaagaaatgcgcgtgacgggcatcctcaagaactacccgcagtggtggatctggggcatcctgggcttctggatgctcatgatctgcaacggcgaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatgtgctcgaacgccatcgtgaagaactccacgaccgaggagatgaagaactgctccttcaacacgacgacggagatccgcgacaaggagaagaaggagtacgccctgttctaccgcccggacatcgtgccgctgaacaacaagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtgcagatcgtgtgcacccgcccgaacaacaacacgcgcaagtccgtccggatcggccctggccagaccttctacgccaccggcgacatcatcggcgacccgcggcaggcccactgcaacatcagcgagaagaagtggaacgagaccctgcagaaggtgggcatcgagctgcagaagcacttccccaacaagaccatcaagtacaaccagtcggccggcggcgacatggagatcaccacgcactccttcaactgcggtggcgagttcttctactgcaacacggccaagctgttcaactcgacgtacaacggcacctacatctccacgaactccacggactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggaggtgcagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggacaaggaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagcgatccaggggttctgccgcgccatccgcaacatccccacccgcatccgccagggcttcgaggcctcgctcctgtagtaagaattcggttaccgggacccggatcc

SEQ ID NO: 255 - DNA, 2602 bp, Artificial Sequence
  Description of Artificial Sequence: Synthetic polynucleotide
gtcgacaagaaatgcgcgtgatgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtgaacaagtccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgggatcgtcggcgacatccggcaggcccactgcaacatcagcaagggcctctggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgagcaacctgttcaacggcacgtacaacggcacctacatctccacgaactcgtccgcgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaagaattcggtgaccgggtcccggatcc

SEQ ID NO: 256 - DNA, 2599 bp, Artificial Sequence
  Description of Artificial Sequence: Synthetic polynucleotide
gtcgacaagaaatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtggagaacggcacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacccgcggcaggcccactgcaacatcagcaaggagaagtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggcgaagctgttcaacagcacgtacaacggcacctacatctccacgaactcgacgaactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtcgccgtggcggagggcaccgaccgcatcatcgaagtcatccaggggttctgccgcgccatccgcaacatcccccggcgcatccgccagggcttcgaggcctcgctcctgtagtaagaattcggtgaccaggacccggatcc

SEQ ID NO: 257 - DNA, 2599 bp, Artificial Sequence
  Description of Artificial Sequence: Synthetic polynucleotide
gtcgacaagaaatgcgcgtgatgggcatccagaagaactacccgcgctggtggatctggggcatcctgggcttctggatgctcatgatctgcaacggcgagggcaagctctgggtgacggtctactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactcgaccacggaggagatgaagaactgctccttcaacacgacgacggagatccgcgacaaggagaagaaggagcacgccctgttctaccgcccggacatcgtgccgctgaacaacgagacgggcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgtcgaagctgttcaacagcacgtacaacggcacctacatctccacgaactcgacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctgggacaacatgacctggatgcagtgggagcgcgagatctccaactacaccgggaccatctacaagctcctcgaggactcccagaaccagcaggagcggaacgagcaggatctgctcgcgctggactcgtggaactccctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagccggacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtcgccgtggcggagggcaccgaccgcatcatcgaagtcatccaggggttctgccgcgccatccgcaacatcccccggcgcatccgccagggcttcgaggcctcgctcctgtagtaagaattcggtgaccaggtcccggatcc

SEQ ID NO: 258 - DNA, 2596 bp, Artificial Sequence
  Description of Artificial Sequence: Synthetic polynucleotide
gtcgacaagaaatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgatcgccacggcgaacggctcgacggtggaggagatgaagaactgctccttcaacacgacgacggagatccgcgacaaggagaagaaggagtacgccctgttctaccgcccggacatcgtgccgctgaacaacaagacgtcgaacatctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatcagcaaggagcggtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacgtcgaacctgttcaacagcacgtacaacgacacctacatctccacgaactcgtccgcgaacaactcctcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacggactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaggatctgctcgcgctggactcgtggaacaacctgtggtcgtggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagctcgacaggctgcgcgggatcgaggaggagggcggcgagcaggaccgcgacaagtccatccgcctggtggacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtcgccgtggcggagggcaccgaccgcatcatcgaagtcatccaggggttctgccgcgccatccgcaacatcccccggcgcatccgccagggcttcgaggcctcgctcctgtagtaagaattcggtgaccgggacctggatcc

SEQ ID NO: 259 - DNA, 2602 bp, Artificial Sequence
  Description of Artificial Sequence: Synthetic polynucleotide
gtcgacaagaaatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggaggagatgaagaactgctccttcaacacgacgacggagatccgcgacaaggagaagaaggagcacgccctgttctaccgcccggacatcgtgccgctgaacaacgagacgggcaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcaacatccggcaggcccactgcaacatcagcgagtcgaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacggcgaagctgttcaacagcacgtacaacggcacctacatctccacgaactcgacgaactcgacgtccaagaacatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcacgacgaacaactcgaacgagacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaggatctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctgcctgcggggcctgcagcgcggctgggaggtgctcaagtacctgggctcgctggtgcagtactggggcctggagctgaagaagtccgccatctccctgttcgacaccctcgccatcacggtggcggagggcaccgaccgcatcatcgaactcatccaggggttctgccgcgccatccgcaacatcccccggcgcatccgccagggcttcgaggcctcgctcctgtagtaagaattcggtgaccgggtcctggatcc

SEQ ID NO: 260 - DNA, 2599 bp, Artificial Sequence
  Description of Artificial Sequence: Synthetic polynucleotide
gtcgacaagaaatgcgcgtgacgggcatcctcaagaactacccgcagtggtggatctggggcatcctgggcttctggatgctcatgacgtgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgacggtggacgagatgaagaactgctccttcaacgcgacgacggagatccgcgacaagaagaagaaggagtacgccctgttctaccgctccgacgtcgtgccgctggacgagacgaacaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccggggcacaacacgcgcaagtccgtccggatcggccctggccagaccttctacgccaccggcgacatcatcggcgacatccggcaggcccactgcaacatcaacgagtcggagtggaacgagaccctgcagaaggtgggcaaggagctgcagaagcacttccccaacaagaccatcaagtacgagcagtcggccggcggcgacatggagatcaccacgcactccttcaactgcggtggcgagttcttctactgcaacacggcggagctgttcaacggcacgtacaacggcaccgacatctccacgaactcgtcggcgaactccacgtccacgatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcatcaacaacgtctcgaacgagacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcggcagcaggagcggaacgagaaggatctgctcgcgctggactcgtggaactcgctgtggaactggttcaacatcaccaactggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgaccggtccatccgcctggtgtccggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccgccatctccctgttcgacaccctcgccatcgccgtggcggagggcaccgaccgcatcatcgaactcatccaggggttctgccgcgccatccgcaacatccccacccgcatccgccagggcttcgaggcctcgctcctgtagtaagaattcggtcaccgggtcccggatcc

SEQ ID NO: 261 - DNA, 2599 bp, Artificial Sequence
  Description of Artificial Sequence: Synthetic polynucleotide
gtcgacaagaaatgcgcgtgacgggcatccggaagaactgcccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgaagttcgaggagatgaagaactgctccttcaacaccacgacggagatccgcgacaaggagaagaaggagtacgccctgttctaccgccccgacatcgtgccgctggacaacgagacgtccaacatctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatctcgaaggagcggtggaacgacaccctgcagaaggtgggcaaggagctgcagaagcacttccccaacaagaccatcaagtacaaccagtcggccggcggcgacatggagatcaccacgcactccttcaactgcggtggcgagttcttctactgcaacacgtccaacctgttcaactcgacgtacaacgacacctacatctccacgaactcgaccaactccacgtcctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaaggactcgaacgagacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgggaccatctacaagctcctcgaggactcccagaaccagcaggagcggaacgagcaggatctgctcgcgctggactcgtggaactcgctgtggaactggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccgctcctccctgcggggcctgcagcgcggctgggaggtgctcaagtacctgggctcgctggtgcagtactggggcctggagctgaagaagtccgccatctccctgttcgacaccctcgccgtggccgtggcggagggcaccgaccgcatcatcgaagtcatccaggggttctgccgcgccatccgcaacatccccaggcgcatccgccagggcttcgaggcctcgctcctgtagtaagaattcggtcaccaggacccggatcc

SEQ ID NO: 262 - DNA, 2674 bp, Artificial Sequence
  Description of Artificial Sequence: Synthetic polynucleotide
gtcgacaagaaatgcgcgtgacgggcatcctgaagaactgcccgctgtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtgaagaactccaccaccgaggagatgagcaacgccaccgtcaagaacagcaccacggaggagatgtccaacgccacggtgaagaactcgacgacagaggagatgaagaactgctccttcaacaccacgacggagatccgcgacaaggagaagaaggagtacgccctgttctaccgccccgacgtcgtgccgctggacgagacgaacaacacctcgaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtccggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtccaacctgttcaactcgacgtacaacgacacctacatctccccgaactcgaccaactccacgtccaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcctcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgggaccatctacaagctcctcgaggactcccagaaccagcaggagcggaacgagcaggatctgctcgcgctggactcgtggaactcgctgtggaactggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccgctcctccctgcggggcctgcagcgcggctgggaggtgctcaagtacctgggctcgctggtgcagtactggggcctggagctgaagaagtccgccatctccctgttcgacaccctcgccgtggccgtggcggagggcaccgaccgcatcatcgaagtcatccaggggttctgccgcgccatccgcaacatccccaggcgcatccgccagggcttcgaggcctcgctcctgtagtaagaattcggtcaccaggtcccggatcc

SEQ ID NO: 263 - DNA, 2656 bp, Artificial Sequence
  Description of Artificial Sequence: Synthetic polynucleotide
gtcgacaagaaatgcgcgtgacgggcatcctgaagaactacccgcgctggtggatctggggcatcctgggcttctggatgctcatgaactgcaacggcgagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtgaacaacaccaccgactacgactccaggagcaacgccaacgtcaccaacatcaccaacaccatcaaggaggaggtgaagaactgctccttcaagaccacgacggagatccgcgacaaggagaagaaggagcacgccctgttctaccgccccgacatcgtgccgctgaactcggagacggggaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgggcaacaacacgcgcaagtccatgcggatcggccctggccagaccttctacgccaccggcgacatcatcggcgacatccggcaggcccactgcaacatctcggagtcgaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacggccaagctgttcaactcgacgtacaacggcacctacatctccacgaactcgtccgccaactccacgtccaagaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggagatccagcccctgggcatcgcacccaccggggccaagaggcgggtcgtggggcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagacggacatctgggagaacatgacctggatgcagtgggagcgcgagatctccaactacaccgagaccatctacaagctcctcgaggactcccagaaccagcaggagcggaacgagcaggatctgctcgcgctggactcgtggaactcgctgtggaactggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccgctcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagccatccaggggttctgccgcgccatccgcaacatccccacccgcatccgccagggcttcgaggcctcgctcctgtagtaagaattcggtcaccgggacctggatcc

SEQ ID NO: 264 - DNA, 2635 bp, Artificial Sequence
  Description of Artificial Sequence: Synthetic polynucleotide
gtcgacaagaaatgcgcgtgacgggcatcctgcggaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccacggaggagatgtccaccgccctcgtgaagaactccacgaccgaggcgatgaagaactgctccttcaacaccacgacggagatccgcgacaaggagaagaaggagtacgccctgttctaccgccccgacatcgtgccgctgaacaacgagacggggaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcacctgcacacgccggtggagatcgtgtgcacccgcccgaacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtcgaagctgttcaactcgacgtacaacgacacctacatctccacgaactcgtccgccaacaactcgtccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcccggactcgaacgagacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagacggacatctgggggaacatgacctggatgcagtgggagcgcgagatctccaactacaccgagaccatctacaagctcctcgaggactcccagaaccagcaggagcggaacgagcagaacctgctcgcgctggactcgtggaactcgctgtggaactggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccgctcctccctgcggggcctgcagcgcggctgggaggtgctcaagtacctgggctcgctggtgcagtactggggcctggagctgaagaagtccgccatctccctgctggacaccatcgccatcgccgtggcggagggcaccgaccgcatcatcgaagccatccaggggttctgccgcgccatccgcaacatccccaggcgcatccgccagggcttcgaggcctcgctcctgtagtaagaattcggtcaccgggtcctggatcc

SEQ ID NO: 265 - DNA, 2599 bp, Artificial Sequence
  Description of Artificial Sequence: Synthetic polynucleotide
gtcgacaagaaatgcgcgtgacgggcatcctgaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgccgctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgggccacaacacgcgcaagtccgtgcggatcggccctggccagaccttctacgccaccggcgacatcatcggcgacatccggcaggcccactgcaacatcaacgagtcgaagtggaacgagaccctgcagaaggtgggcaacgagctgcagaagcacttccccaacaagaccatcaagtacgagcaggcggccggcggcgacatggagatcaccacgcactccttcaactgcggtggcgagttcttctactgcaacacggccaacctgttcaacggcacgtacaacgggaccgacatctccacgaactcgtccgccaactcgacgtccacgatcacgctccagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcgccagcaggagcggaacgagaaagacctgctcgcgctggactcgtggaactcgctgtggaactggttcaacatcaccaactggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgaccggtccatccgcctggtgtcgggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagaagggcgccatctccctgttcgacaccctcgccatcaccgtggcggagggcaccgaccgcatcatcgaagtcatccaggggttctgccgcgccatccgcaacatccccacgcgcatccgccagggcttcgaggcctcgctcctgtagtaagaattcggtaaccgggtcccggatcc

SEQ ID NO: 266 - DNA, 2629 bp, Artificial Sequence
  Description of Artificial Sequence: Synthetic polynucleotide
gtcgacaagaaatgcgcgtgacgggcatcctgaagaactacccgcggtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccaccgaggagatgtccaacgccacggtgaagaactccacgacggaggagatgaagaactgctccttcaacaccacgacggagatccgcgacaaggagaagaaggagtacgccctgttctaccgccccgacgtcgtgccgctggacgagacgaacaacacgtccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccgctacaaccagtccgccggcggcgacatggagatcaccacgcactccttcaactgcggtggcgagttcttctactgcaacacggccaagctgttcaactccacgtacaacgacacctacaagtccacgaactcgtccgccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacaactggcgctccgagctgtacaagtacaaggtggtggaggtccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttctccatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctgcctgcggggcctgcagcgcggctgggaggtgctcaagtacctgggctcgctggtgcagtactggggcctggagctgaagaagtccgccatctccctgttcgacaccctcgccgtggccgtggcggagggcaccgaccgcatcatcgaactcatccaggggttctgccgcgccatccgcaacatcccccggcgcatccgccagggcttcgaggcctcgctcctgtagtaagaattcggtaaccaggacccggatcc

SEQ ID NO: 267 - DNA, 2656 bp, Artificial Sequence
  Description of Artificial Sequence: Synthetic polynucleotide
gtcgacaagaaatgcgcgtgacgggcatcctgaagaactacccgcggtggtggatctggggcatcctgggcttctggatgctcatgaactgcaacggcgagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgacaccgtgaccaacatcacgaacacgatcaaggaggaggtgaagaactgctccttcaagaccacgacggagatccgcgacaaggagaagaaggagcacgccctgttctaccgccccgacatcgtgccgctgaactccgagacgggcaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagaccatcatcgtgcacctgcacacgccggtggagatcgtgtgcacccgcccgggcaacaacacgcgcaagtccatgcggatcggccctggccagaccttctacgccaccggcgacatcatcggcgacatccggcaggcccactgcaacatctcggaggagaagtggaacaagaccctgcaggaggtgggcaaggagctgcagaagcacttccccaaccggaccatcaagtacaaccagtccgccggcggcgacatggagatcaccacgcactccttcaactgcggtggcgagttcttctactgcaacacgtccaagctgttcaactccacgtacaacgacacctacatctccacgaactcgaccaactcgtccgccaacaactcgtccatcatcacgctccagtgccggatcaagcagatcatcaacatgtggcagggggtgggccgcgctatgtacgcaccgcccatcgccggcaacatcatctgcaagtccaacatcaccggcctcctgctgacccgcgacggcggcccggactcgaacaagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccatcgccgtggcggagggcaccgaccgcatcatcgaagccatccaggggttctgccgcgccatccgcaacatcccccggcgcatccgccagggcttcgaggcctcgctcctgtagtaagaattcggtaaccaggtcccggatcc

SEQ ID NO: 268 - DNA, 2650 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccaacccgcaggagatgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgactccgtgaccaacatcacgaacacgatcaaggaggaggtgaagaactgctccttcaagaccacgacggagatccgcgacaaggagaagaaggagcacgccctgttctaccgccccgacatcgtgccgctcaactccgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcagctgaacacgtccgtggagatcgtgtgcacccgcccgggcaacaacacgcgcaagtccgtgcggatcggccctggccagaccttctacgccaccggcgacatcatcggcgacatccggcaggcccactgcaacatctcggagaagaagtggaacgagaccctgcagcgggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatcaacacgacctcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtcgccgtggcggagggcaccgaccgcatcatcgaagccatccaggggttctgccgcgccatccgcaacatcccccggcgcatccgccagggcttcgaggcctcgctcctgtagtaagaattcggtaaccgggacctggatcc

SEQ ID NO: 269 - DNA, 2599 bp, Artificial Sequence
  Description of Artificial Sequence: Synthetic polynucleotide
gtcgacaagaaatgcgcgtgacgggcatcctgaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgtccctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagacgatcatcgtgcacctgcacgccccggtggagatcgtgtgcacccgcccgggccacaacacgcgcaagtccgtgcggatcggccctggccagaccttctacgccaccggcgacatcatcggcaacatccggcaggcccactgcaacatcaacgagtcggagtggaacgagaccctgcagaaggtgggcaaggagctgcgcaagcacttccccaacaagaccatcaagtacgagcagtccgccggcggcgacatggagatcaccacgcactccttcaactgcggtggcgagttcttctactgcaacacggccaacctgttcaacggcacgtacaacgggaccgacatctccacgaactcgtccgccgaccgcaactccacgatcacgctcgagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgccacggagaccttcaggccagcgggaggcgacatgcgcgacaactggcgctccgagctgtacaagtacaaggtggtggaggtccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcgccagcaggagcggaacgagaaagacctgctcgcgctggactcgtggaactcgctgtggaactggttcaacatcaccaactggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgaccggtccatccgcctggtgtcgggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccaccatctccctgttcgacaccctcgccatcgccgtggcggagggcaccgaccgcatcatcgaactcatccaggggttctgccgcgccatccgcaacatccccacgcgcatccgccagggcttcgaggcctcgctcctgtagtaagaattcggtaaccgggtcctggatcc

SEQ ID NO: 270 - DNA, 2620 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgagaactccacggaggccatgaagaactgctccttcaacaccacgacggagatccgcgacaagatcaagaaggagcgggccctgttctaccgccccgacatcgtgccgctcaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgagatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccaccatctccctgttcgacaccctcgccatcgccgtcgcggagggcaccgaccgcatcatcgaactcatccaggggttctgccgcgccatccgcaacatccccacccgcatccgccagggcttcgaggcctcgctcctgtagtaagaattcggttaccgggtcccggatcc

SEQ ID NO: 271 - DNA, 2638 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgtccaacgtcaccgtcaacaacatcaccatcgaggagatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacgccccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgcaagatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggaacaacatgacctggatgcagtgggagcgcgagatctccaactacaccgggaccatctacaagctcctcgaggactcccagaaccagcaggagcggaacgagaaggatctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgccggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtggccgtcgcggagggcaccgaccgcatcatcgaactcatccaggggttctgccgcgccatccgcaacatcccccggcgcatccgccagggcttcgaggcctcgctcctgtagtaagaattcggttaccaggacccggatcc

SEQ ID NO: 272 - DNA, 2644 bp, Artificial Sequence
  Description of Artificial Sequence: Synthetic polynucleotide
gtcgacaagaaatgcgcgtgatgggcatcctgaagaactacccgcggtggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacgaactcgatcaactcgacgctgaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggagtcccagaaccagcaggagcggaacgagcaagacctgctcgcgctggactcgtggaactcgctgtggaactggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcggcatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtggccgtcgcggagggcaccgaccgcatcatcgaagccatccaggggttctgccgcgccatccgcaacatcccccggcgcatccgccagggcttcgaggcctcgctcctgtagtaagaattcggttaccaggtcccggatcc

SEQ ID NO: 273 - DNA, 2638 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgaggagatcagcaacgccaccgtcaagaacatcaccatcaaggagatgaagaactgctccttcaacaccacgacggagatccgcgacaagatcaagaaggagcgggccctgttctaccgcaccgacatcgtgccgctgaacaaggagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggcaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaagaggcgggtcgtggagcgcggcaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctggaacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttcgacatcaccaagtggctgtggtacatcaagatcttcatcatgatcgtcggcggcctgatcggcctgcgcatcatcttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgccatctccctgttcgacaccctcgccgtggccgtcgcggagggcaccgaccgcatcatcgaagccatccaggggttctgccgcgccatccgcaacatcccccggcgcatccgccagggcttcgaggcctcgctcctgtagtaagaattcggttaccgggacctggatcc

SEQ ID NO: 274 - DNA, 2641 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgagcaacgtcaccgtcaacaacatcaccatcgaggagatgaagaactgctccttcaacaccacgacggagatccgcgacaagatcaagaaggagcgggccctgttctaccgcccggacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagaccatcatcgtgcacctgcacgccccggtggagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccaccaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcccggacaacaagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggtcggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcctggttcaacatcaccaagtggctgtggtacatcaagatcttcatcatgatcgtcggcggcctgatcggcctgcgcatcgtcttcgccgtgctgtcgatcgtgaaccgcgtgcgccagggctactccccgctgtccctgcaaacgctgacccccaacccccgggagcccgacaggctgcgcgagatcgaggaggagggcggcgagcaggaccgcgaccggtccatccgcctggtgtccggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccaccatctccctgttcgacaccctcgccatcgccgtcgcggagggcaccgaccgcatcatcgaactgatccaggggttctgccgcgccatccgcaacatccccacgcgcatccgccagggcttcgaggcctcgctcctgtagtaagaattcggttaccgggtcctggatcc

SEQ ID NO: 275 - DNA, 2644 bp, Artificial Sequence
  Description of Artificial Sequence: Synthetic polynucleotide
gtcgacaagaaatgcgcgtgatgggcatcctgaagaactacccgcggtggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacgaccaagctgttcaactccacgtacaacggcacctacatctccacgaactcgatcaactcgacgctgaacatcacgctccagtgccggatcaagcagatcatcaacatgtggcaggggatcggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaagaggcgggtcgtggagcgcgggaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctgggacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttcgacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcggcatcgaggaggagggcggcgagcaggaccgcgacaagtccatccgcctggtgaacggcttcctgcccatcgtgtgggacgacctgcgctccctgtgcctgttctcgtaccaccgcctgcgcgacttcctcctgctggcggcccgcgtcgtggagctgctgggccggtcctgcctgcggggcctgcagcgcggctgggaggtgctcaagtacctgggctcgctggtgcagtactggggcctggagctgaagaagtccgccatctccctgttcgacaccctcgccgtggccgtcgcggagggcaccgaccgcatcatcgaagtcatccaggggttctgccgcgccatccgcaacatcccccggcgcatccgccagggcttcgaggcctcgctcctgtagtaaggtgaccgggacccgaattcggatcc

SEQ ID NO: 276 - DNA, 2611 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccacggtcgagaactccacggaggccatgaagaactgctccttcaacaccacgacggagatccgcgacaagatcaagaaggagcgggccctgttctaccgccccgacatcgtgccgctcaacaacgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggaaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctccccgaactcgaccaactcgacctccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgagtccaacgagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccaccatctccctgttcgacaccctcgccatcgccgtcgcggagggcaccgaccgcatcatcgaactcatccaggggttctgccgcgccatccgcaacatccccacccgcatccgccagggcttcgaggcctcgctcctgtagtaaggtcaccgggacccgaattcggatcc

SEQ ID NO: 277 - DNA, 2620 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgggaactccacggaggccatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaagaggcgggtcgtggagcgcgagaagcgcgcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgaccgctccatccgcctggtgtccggcttcctgcccatcgtgtgggacgacctgcgctccctgtgcctgttctcgtaccaccgcctgcgcgacttcctcctgctggcggcccgcgtcgtggagctgctgggccactcctccctgcggggcctgcagcgcggctgggaggtgctcaagtacctgggctcgctggtgcagtactggggcctggagctgaagcggtccaccatctccctgttcgacaccctcgccatcgccgtcgcggagggcaccgaccgcatcatcgaactcatccaggggttctgccgcgccatccgcaacatccccacccgcatccgccagggcttcgaggcctcgctcctgtagtaaggtaaccgggacccgaattcggatcc

SEQ ID NO: 278 - DNA, 2644 bp, Artificial Sequence
  Description of Artificial Sequence: Synthetic polynucleotide
gtcgacaagaaatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtccggaactccacgaccgagaagatgtccgacgcgctggaccgcaactcgacgaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgccaagatcatcatcgtgcagctgaacgcgaacgcctccgtggagatcgtgtgcacccgcccgaacaacaacacgcgcaagtccgtgcggatcggccctggccagaccttctacgccaccggcgacatcatcggcgacatccggcaggcccactgcaacatctcggagaagaagtggaacgagaccctgcagcaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacggactcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgtgacggagaccttcaggccagcgggaggcgacatgcgggacaactggcgctccgagctgtacaagtacaaggtggtggagatccagcccctgggcatcgcacccaccggggccaagaggcgggtcgtggggcgcgagaagcgcgcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggagtcccagaaccagcaggagcggaacgagcaagacctgctcgcgctggactcgtggaactcgctgtggtcgtggttcaacatcaccaagtggctgtggtacatcaagatcttcatcatgatcgtcggcggcctgatcggcctgcgcatcgtgttcgccgtgctgtcgatcgtgaaccgcgtgcgccagggctactccccgctgtccctgcaaacgctgacccccaacccccgggagcccgacaggctgcgcgggatcgaggaggagggcggcgagcaggaccgcgacaagtccatccgcctggtgtccggcttcctgcccatcgtgtgggacgacctgcgctccctgtgcctgttctcgtaccaccgcctgcgcgacttcctcctgctggcggcccgcgtcgtggagctgctgggccggtcctccctgcggggcctgcagcgcggctgggaggtgctcaagtacctgggctcgctggtgcagtactggggcctggagctgaagaagtccgcgatctccctgttcgacaccctcgccatcgccgtcgcggagggcaccgaccgcatcatcgaagcgatccaggggttctgccgcgccatccgcaacatcccccggcgcatccgccagggcttcgaggcctcgctcctgtagtaaggttaccgggacccgaattcggatcc

SEQ ID NO: 279 - DNA, 2601 bp, Human immunodeficiency virus
atgagagtgatggggatactgaagaattatccacaatggtggatatggggcatcttaggcttttggatgctaatgatttgtaatgggaaaggaaacttgtgggtcacagtctattatggggtaccagtatggaaagaagcaaaaactactctgttttgtgcatcagatgccaaagcatatgagaaagaagtgcataatgtctgggctacacatgcctgtgtacccacagaccccagcccacaagaattggttttggaaaatgtaacagaaaattttaacatgtggaaaaatgatatggtagatcagatgcatgaggatataatcagtctatgggatcaaagcctaaagccatgtgtaaagttgaccccactctgtgtcactttaaattgtagtaatgctactgttgacagtagtaaagtttatgatactaggagtaatgttaatgttaccagtatcaataataccataatgggagaaatgaaaaattgctctttcaatacaaccacagaaataagagataaggaaaagaaggaatatgcacttttttatagacctgatgtagtaccacttgatgaaacaagcaataccagtgagtatagattaataaattgtaatacctcagccgtaacacaagcctgtccaaaggtcacttttgaaccaattcctatacattattgtgctccagctggttatgcgattctaaagtgtaataataagacattcaatggaacaggaccatgcagtaatgtcagcacagtacaatgtacacatggaattaggccagtggtatcaacccaactactgttaaatggtagtctggcagaaaaagagatagtaattagatctgaaaacctgacaaacaatgccaaaataataatagtccatcttaacacctctgtagaaattgtgtgtacaaggcccggcaataatacaaggaaaagtgtgagaataggaccaggacaaacattctatgcaacaggagacataataggagatataagacaagcacattgtaacattagtgaaaggcaatggaataaaactttacaagaggtaggtaaagaattgcaaaaacacttccctaataagacaataaagtatgaacgatccgcaggaggagacatggaaattgcaacacatagctttaattgtggaggagaatttttctattgcaatacatcaaatctgtttaatggtacatacaatggtacatacataagtacaaacagtacttcaaacatcacgcttcaatgcagaataaaacaaattataaacatgtggcagggggtaggaagagcaatgtatgctcctcccattgcaggaaacataacatgtaaatcaaatatcacagggctactattgacacgtgatggagggaccaaaaataatagcaacgagacagaggagacattcaggcctgcaggaggagatatgagggataattggagaagtgaattatataaatataaagtagtagaaattcagccattaggaatagcaccaactggtgcaaaaaggagagtggtggagagagaaaaaagagcagcaggactaggagctttgttccttgggttcttgggagcagcaggaagcactatgggcgcagcatcaataacgctgacggtacaggccagacaattgttgtctggtatagtgcaacagcaaagcaatttgctgagggctatagaggcgcaacagcatatgttgcaactcacggtctggggcatcaagcagctccaggcaagagtcctggctctggaaagatacctaaaggatcaacagctcctagggatgtggggctgctctggaaaactcatctgcaccactgctgtgccttggaacactagttggagtaataaatctgaaaaggatatttgggataacatgacatggatgcagtgggagagagaaattagcaattacacagagacaatatacatgttgcttgaagactcgcaacaccagcaggaaagaaatgaaaaagatttactagcattggacagttggaacagtctgtggaattggtttaacataacaaactggctgtggtatataagaatattcataatgatagtagggggcttgataggtttaagaatagtttttgctgtgctatctatagtgaatagagtcaggcagggatactcacctttgtcgttgcagacccttaccccaaacccgagggaacccgacaggctcagaggaatcgaagaagaaggtggagagcaagacagagacagatccattcgattagtgagcggattcttgccaattgtctgggacgacctgcggagcctgtgcctcttcagttaccaccgattgagagactttctattgctggcagcgagagtggtggaacttctgggacgcagcagtctcaggggactgcagagggggtgggaagtccttaagtatctgggaagtcttgtgcagtattggggtctggaactaaaaaagagtgctattagtctttttgataccatagcaatagcagtagctgaaggaacagataggattatagaagtaatacaaagattttgtagagctatccgcaacatacctacaagaataagacaaggctttgaagcatctttgctataa

SEQ ID NO: 280 - protein, 866 aa, Artificial Sequence; identical to SEQ ID NO: 2
  Description of Artificial Sequence: Synthetic polypeptide

SEQ ID NO: 281 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 282 - DNA, 2088 bp, Artificial Sequence
  Description of Artificial Sequence: Synthetic polynucleotide
aagcttgtcgacaccatgcgcgtgatgggcatcctgaagaactacccccagtggtggatctggggcatcctgggcttctggatgctgatgatctgcaacggcaagggcaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtggactcctccaaggtgtacgacacccgctccaacgtgaacgtgacctccatcaacaacaccatcatgggcgagatgaagaactgctccttcaacaccaccaccgagatccgcgacaaggagaagaaggagtacgccctgttctaccgccccgacgtggtgcccctggacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagcgccagtggaacaagaccctgcaggaggtgggcaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatctccaccaactccacctccaacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggaggccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccgccgtgccctggaacacctcctggtccaacaagtccgagaaggacatctgggacaacatgacctggatgcagtgggagcgcgagatctccaactacaccgagaccatctacatgctgctggaggactcccagcaccagcaggagcgcaacgagaaggacctgctggccctggactcctggaactccctgtggaactggttcaacatcaccaactggctgtggtacatccgctagggatcctctaga

SEQ ID NO: 283 - DNA, 2061 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcaagggcaacctgtgggtgaccgtgtactacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtggactcctccaaggtgtacgacacccgctccaacgtgaacgtgacctccatcaacaacaccatcatgggcgagatgaagaactgctccttcaacaccaccaccgagatccgcgacaaggagaagaaggagtacgccctgttctaccgccccgacgtggtgcccctggacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagcgccagtggaacaagaccctgcaggaggtgggcaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatctccaccaactccacctccaacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggaggccgccggcctgggcgccctgttcctgggcttcctgggcgccgccggctccaccatgggcgccgcctccatcaccctgaccgtgcaggcccgccagctgctgtccggcatcgtgcagcagcagtccaacctgctgcgcgccatcgaggcccagcagcacatgctgcagctgaccgtgtggggcatcaagcagctgcaggcccgcgtgctggccctggagcgctacctgaaggaccagcagctgctgggcatgtggggctgctccggcaagctgatctgcaccaccgccgtgccctggaacacctcctggtccaacaagtccgagaaggacatctgggacaacatgacctggatgcagtgggagcgcgagatctccaactacaccgagaccatctacatgctgctggaggactcccagcaccagcaggagcgcaacgagaaggacctgctggccctggactcctggaactccctgtggaactggttcaacatcaccaactggctgtggtacatccgctag

SEQ ID NO: 284 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 285 - DNA, 1539 bp, Artificial Sequence
  Description of Artificial Sequence: Synthetic polynucleotide
aagcttgtcgacaccatgcgcgtgatgggcatcctgaagaactacccccagtggtggatctggggcatcctgggcttctggatgctgatgatctgcaacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtggactcctccaaggtgtacgacacccgctccaacgtgaacgtgacctccatcaacaacaccatcatgggcgagatgaagaactgctccttcaacaccaccaccgagatccgcgacaaggagaagaaggagtacgccctgttctaccgccccgacgtggtgcccctggacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagcgccagtggaacaagaccctgcaggaggtgggcaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatctccaccaactccacctccaacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtagggatcctctaga

SEQ ID NO: 286 - DNA, 1512 bp, Artificial Sequence
  Description of Artificial Sequence: Synthetic polynucleotide
atgcgcgtgatgggcatcctgaagaactacccccagtggtggatctggggcatcctgggcttctggatgctgatgatctgcaacggcgtgcccgtgtggaaggaggccaagaccaccctgttctgcgcctccgacgccaaggcctacgagaaggaggtgcacaacgtgtgggccacccacgcctgcgtgcccaccgacccctccccccaggagctggtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccaacgccaccgtggactcctccaaggtgtacgacacccgctccaacgtgaacgtgacctccatcaacaacaccatcatgggcgagatgaagaactgctccttcaacaccaccaccgagatccgcgacaaggagaagaaggagtacgccctgttctaccgccccgacgtggtgcccctggacgagacctccaacacctccgagtaccgcctgatcaactgcaacacctccgccgtgacccaggcctgccccaaggtgaccttcgagcccatccccatccactactgcgcccccgccggctacgccatcctgaagtgcaacaacaagaccttcaacggcaccggcccctgctccaacgtgtccaccgtgcagtgcacccacggcatccgccccgtggtgtccacccagctgctgctgaacggctccctggccgagaaggagatcgtgatccgctccgagaacctgaccaacaacgccaagatcatcatcgtgcacctgaacacctccgtggagatcgtgtgcacccgccccggcaacaacacccgcaagtccgtgcgcatcggccccggccagaccttctacgccaccggcgacatcatcggcgacatccgccaggcccactgcaacatctccgagcgccagtggaacaagaccctgcaggaggtgggcaaggagctgcagaagcacttccccaacaagaccatcaagtacgagcgctccgccggcggcgacatggagatcgccacccactccttcaactgcggcggcgagttcttctactgcaacacctccaacctgttcaacggcacctacaacggcacctacatctccaccaactccacctccaacatcaccctgcagtgccgcatcaagcagatcatcaacatgtggcagggcgtgggccgcgccatgtacgccccccccatcgccggcaacatcacctgcaagtccaacatcaccggcctgctgctgacccgcgacggcggcaccaagaacaactccaacgagaccgaggagaccttccgccccgccggcggcgacatgcgcgacaactggcgctccgagctgtacaagtacaaggtggtggagatccagcccctgggcatcgcccccaccggcgccaaggagcgcgtggtggagcgcgagaaggagtag

SEQ ID NO: 287 - DNA, 1540 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgcactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 288 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcgaacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcgggacccggatcc

SEQ ID NO: 289 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcgggacccggatcc

SEQ ID NO: 290 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtaaccgaattcgggacccggatcc

SEQ ID NO: 291 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtccaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcgggacccggatcc

SEQ ID NO: 292 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcgggtcccggatcc

SEQ ID NO: 293 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcggcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaagtgcagcaacgccatcgtggactccagcaaggtgtacgacacgaggtccaaggtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacctcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcaggacccggatcc

SEQ ID NO: 294 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcaggtcccggatcc

SEQ ID NO: 295 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggccacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcgggacctggatcc

SEQ ID NO: 296 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtgaccgaattcgggtcctggatcc

SEQ ID NO: 297 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcgggtcccggatcc

SEQ ID NO: 298 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcaggacccggatcc

SEQ ID NO: 299 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcaggtcccggatcc

SEQ ID NO: 300 - DNA, 1571 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtccgacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactcctcgaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcgggacctggatcc

SEQ ID NO: 301 - DNA, 1559 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagctcgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtcaccgaattcgggtcctggatcc

SEQ ID NO: 302 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtaaccgaattcgggtcccggatcc

SEQ ID NO: 303 - DNA, 1559 bp, Artificial Sequence
  Description of Artificial Sequence: Synthetic polynucleotide
ggtcgacaagaagccaccatgcgcgtgatgggcatcccgaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccatcgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggcccgcgagcgggtcgtggagcgcgagaaggagtagtaaggtaaccgaattcaggacccggatcc

SEQ ID NO: 304 - DNA, 1559 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtaaccgaattcaggtcccggatcc

SEQ ID NO: 305 - DNA, 1559 bp, Artificial Sequence
  Description of Artificial Sequence: Synthetic polynucleotide
ggtcgacaagaagccaccatgcgcgtgatgggcatccccaagaactacccgcagtggtggatctggggcatcctgggcttctggatactcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcaacagcgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagggccagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtaaccgaattcgggacctggatcc

SEQ ID NO: 306 - DNA, 1571 bp, Artificial Sequence
  Description of Artificial Sequence: Synthetic polynucleotide
ggtcgacaagaagccaccatgcgcgtgcggggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagcgccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgacgaactcctccaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggtaaccgaattcgggtcctggatcc

SEQ ID NO: 307 - DNA, 1559 bp, Artificial Sequence
  Description of Artificial Sequence: Synthetic polynucleotide
ggtcgacaagaagccaccatgcgcgtgatgggcatcctcaagaactacctgcagtggtggatctggggcatcctgggcttctggatgctcatgatctgcaagggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgacctgcagcaacgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgatcaactccacgagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcgggtcccggatcc

SEQ ID NO: 308 - DNA, 1529 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcaggacccggatcc

SEQ ID NO: 309 - DNA, 1523 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcctccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcaggtcccggatcc

SEQ ID NO: 310 - DNA, 1529 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcgggacctggatcc

SEQ ID NO: 311 - DNA, 1523 bp, Artificial Sequence
  Description of Artificial Sequence: Synthetic polynucleotide
ggtcgacaagaagccaccatgcgggtgatgggcatcctcaagaactacccgcgctggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcaccgacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaaggttaccgaattcgggtcctggatcc

SEQ ID NO: 312 - DNA, 1520 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtcgaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcacctacatctccaccaactccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaacaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacccgaattcggtgaccggatcc

SEQ ID NO: 313 - DNA, 1526 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcccgtacatcaacatctccaccaactccaacagcaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacccgaattcggtcaccggatcc

SEQ ID NO: 314 - DNA, 1526 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctggactgctcgaacgtgaacgtcgtgaacgtcacgaacatcaccaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacccgaattcggtaaccggatcc

SEQ ID NO: 315 - DNA, 1517 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaagggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgtccaacgtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctactccaccaactccaccagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacccgaattcggttaccggatcc

SEQ ID NO: 316 - DNA, 1532 bp, Artificial Sequence
  Description of Artificial Sequence: Synthetic polynucleotide
ggtcgacaagaagccaccatgcgggtgatgggcatcctcaagaactacccgccgtggtggatctggggcatcctgggcttctggatgctcatgatctgcaacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgaacgtggtgaacgtcacgaacatcacgaacacgatcaagggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgaccaactcgtccgcgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcccgaattcggtgaccggatcc

SEQ ID NO: 317 - DNA, 1560 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaagggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgcctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcaccgacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggacccgaattcggtgaccggatcc

SEQ ID NO: 318 - DNA, 1533 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtgaccgggtccaacgtgaacgtcacgaacatcacgaacacgatcaccggcgagatgaagaactgctccttcaacacgacgacggagatccgcgacaaggagaagaaggagtacgccctgttctacaagcccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcggcatcatcggcgacatccgccaggcccactgcaacatcagcgagtcgaagtggaacgagaccctgcacgaggtgtccaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggtcccgaattcggtgaccggatcc

SEQ ID NO: 319 - DNA, 1532 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtggtgaacgtcacgaacatcacgaacacgatcaagggcgagatgaagaactgctccttcaacacgacgacggagatccgcgacaaggagaagaaggagtacgccctgttctaccgccccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcaagtacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaactcgacggagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacctgaattcggtgaccggatcc

SEQ ID NO: 320 - DNA, 1559 bp, Artificial Sequence
  Description of Artificial Sequence: Synthetic polynucleotide
ggtcgacaagaagccaccatgcgggtgatgggcatcctcaagaactgcccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctcgaacgtgtccgtcacgtccatcaacaacacgatcatgggcgagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgtccaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaccaacatctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcctgaattcggtgaccggatcc

SEQ ID NO: 321 - DNA, 1508 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcgtgaacgtcacgaacatcacgaacacgatcaagggcgagatgaagaactgctccttcaacacgacgacggagatccgcgacaaggagaagaaggagtacgccctgttctaccgccccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccggggaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaacggctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcccgaattcggtcaccggatcc

SEQ ID NO: 322 - DNA, 1554 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgcgaacgtcacgtccatcaacaacacgatcatgggcgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggaccaactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggacccgaattcggtcaccggatcc

SEQ ID NO: 323 - DNA, 1554 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgatctgctcgggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaagctgttcaacggcacctacaacgggatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaaccggaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggtcccgaattcggtcaccggatcc

SEQ ID NO: 324 - DNA, 1505 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgggcgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacctgaattcggtcaccggatcc

SEQ ID NO: 325 - DNA, 1505 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccatgggcgagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtgatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgcgatcatcggcgacatccgccaggcccactgcaacatcagcgagtccaagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcctgaattcggtcaccggatcc

SEQ ID NO: 326 - DNA, 1508 bp, Artificial Sequence
  Description of Artificial Sequence: Synthetic polynucleotide
ggtcgacaagaagccaccatgaaggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagaggtcggccggcggcgacatggagatcaccacgcactccttcaactgcggtggcgagttcttctactgcaacacgtcgaagctgttcaacggcacgtacaacgggaccgacatctccacgaactcgtccgcgaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcccgaattcggtaaccggatcc

SEQ ID NO: 327 - DNA, 1506 bp, Artificial Sequence
  Description of Artificial Sequence: Synthetic polynucleotide
ggtcgacaagaagccaccatgcgggtgatgggcatcctcaagaactgcccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggacccgaattcggtaaccggatcc

SEQ ID NO: 328 - DNA, 1509 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacaaccgggtggaccagatgcacgaggacatcatctccctgtgggaccagtccctgaagccctgcgtgaagctgaccccgctgtgcgtgaccctgatctgctcgaacgccacggtggacaaccgcaccgtcggggagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaaccggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcggcatcatcggcgacatccgccaggcccactgcaacatcagcgaggggcagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacggcacgtacaacggcacctacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggtcccgaattcggtaaccggatcc

SEQ ID NO: 329 - DNA, 1559 bp, Artificial Sequence
  Description of Artificial Sequence: Synthetic polynucleotide
ggtcgacaagaagccaccatgcgggtgacgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcgccccgccggcggcgacctggagatcaccacgcactccttcaactgcggtggcgagttcttctactgcaacacgtcgaagctgttcaacggcacgtacaacggcaccgacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacctgaattcggtaaccggatcc

SEQ ID NO: 330 - DNA, 1571 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcgcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaccagcaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcctgaattcggtaaccggatcc

SEQ ID NO: 331 - DNA, 1514 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaagggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccgctcggacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgagatccgccaggcccactgcaacatcagcgagtcgaagtggaacgagaccctgcagaaggtgggcaaggagctgcagaagcacttccccaacaagacgattaagtacgagcgctcggccggcggcgacatggagatcaccacgcactccttcaactgcggtggcgagttcttctactgcaacacgtcgaagctgttcaacggcacgtacaacggcaccgacatctccacgaactcgtccgccaactcgaacagcacgatcacgctccagtgccgcatcaagcagatcatcaacatctggcagggggtgggccgcgctatgtacgcaccgcccatcgccggcaacatcacctgcaagtccaacatcaccggcctcctgctgacccgcgacggcggcaacaacaacaaccggaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcccgaattcggttaccggatcc

SEQ ID NO: 332 - DNA, 1518 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggacaaccgcaccgtcggcgagatgaagaactgctccttcaacacgacgacggagatccgcgacaaggagaagaaggagtacgccctgttctaccgcccggacatcgtgccgctgtccgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgagatcaagcaggcccactgcaacatcagcgaggagaagtggaacgagaccctgcagaaggtgggcaaggagctgcagaagcacttccccaacaagatcattaagtacgcccagtcggccggcggcgacatggagatcaccacgcactccttcaactgcggtggcgagttcttctactgcaacacggcgaacctgttcaacggcacgtacaacggcaccgacatctccacgaactcgtccaccaagtcgaacagcacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggacccgaattcggttaccggatcc

SEQ ID NO: 333 - DNA, 1515 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacgtccaacctgttcaacggcacgtacaacggcacctacatgaacatctccaccgactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaggtcccgaattcggttaccggatcc

SEQ ID NO: 334 - DNA, 1517 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagtccaagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaccacgtccaagctgttcaacgggacgtacaacggcacggacatctccacgaactcctcggcgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcgggaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggacctgaattcggttaccggatcc

SEQ ID NO: 335 - DNA, 1523 bp, Artificial Sequence
  Description of Artificial Sequence: Synthetic polynucleotide
ggtcgacaagaagccaccatgcgcgtgaccggcatcctcaagaactacccgcagtggtggatctggggcatcctgggcttctggatgctcatgaactgcaacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggccaacctgttcaacgggacgtacaacggcacggacatctccacgaactcctcgacgaagtcgaactcgacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcaacaactcgagcaagacggaggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggtcctgaattcggttaccggatcc

SEQ ID NO: 336 - DNA, 1517 bp, Artificial Sequence
  Description of Artificial Sequence: Synthetic polynucleotide
ggtcgacaagaagccaccatgcgcgtgatgggcatccccaagaactgcccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacggccaagctgttcaacgggacgtacaacggcacggacatctccacgaactcctcggcggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcaccaactcgagcgaggaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtgaccgggacccggatcc

SEQ ID NO: 337 - DNA, 1514 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacacgcggcaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtcaccgggacccggatcc

SEQ ID NO: 338 - DNA, 1511 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgcacgccacggtggagaactccacgaccgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcggcatcatcggcgagatccggcaggcccactgcaacatcagcaaggagacctggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggccaagctgttcaactcgacgtacaacggcacctacatctccacgaactccacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgtcggaggaggagatcttcaggccagcgggaggcgacatgcgcgacaactggcgctccgagctgtacaagtacaaggtggtggaggtgcagcccctgggcatcgcacccaccggggccaaggagcgggtcgtggagcgcgagaaggagtagtaagaattcggtaaccgggacccggatcc

SEQ ID NO: 339 - DNA, 1517 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatgtgctcgaacgccatcgtgaagaactccacgaccgaggagatgaagaactgctccttcaacacgacgacggagatccgcgacaaggagaagaaggagtacgccctgttctaccgcccggacatcgtgccgctgaacaacaagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtgcagatcgtgtgcacccgcccgaacaacaacacgcgcaagtccgtccggatcggccctggccagaccttctacgccaccggcgacatcatcggcgacccgcggcaggcccactgcaacatcagcgagaagaagtggaacgagaccctgcagaaggtgggcatcgagctgcagaagcacttccccaacaagaccatcaagtacaaccagtcggccggcggcgacatggagatcaccacgcactccttcaactgcggtggcgagttcttctactgcaacacggccaagctgttcaactcgacgtacaacggcacctacatctccacgaactccacggactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggagtagtaagaattcggttaccgggacccggatcc

SEQ ID NO: 340 - DNA, 1520 bp, Artificial Sequence
  Description of Artificial Sequence: Synthetic polynucleotide
ggtcgacaagaagccaccatgcgcgtgatgggcatcctcaagaactacccgcgctggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtgaacaagtccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgggatcgtcggcgacatccggcaggcccactgcaacatcagcaagggcctctggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgagcaacctgttcaacggcacgtacaacggcacctacatctccacgaactcgtccgcgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtgaccgggtcccggatcc

SEQ ID NO: 341 - DNA, 1517 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtggagaacggcacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacccgcggcaggcccactgcaacatcagcaaggagaagtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggcgaagctgttcaacagcacgtacaacggcacctacatctccacgaactcgacgaactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtgaccaggacccggatcc

SEQ ID NO: 342 - DNA, 1517 bp, Artificial Sequence
  Description of Artificial Sequence: Synthetic polynucleotide
ggtcgacaagaagccaccatgcgcgtgatgggcatccagaagaactacccgcgctggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactcgaccacggaggagatgaagaactgctccttcaacacgacgacggagatccgcgacaaggagaagaaggagcacgccctgttctaccgcccggacatcgtgccgctgaacaacgagacgggcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgtcgaagctgttcaacagcacgtacaacggcacctacatctccacgaactcgacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtgaccaggtcccggatcc

SEQ ID NO: 343 - DNA, 1514 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgatcgccacggcgaacggctcgacggtggaggagatgaagaactgctccttcaacacgacgacggagatccgcgacaaggagaagaaggagtacgccctgttctaccgcccggacatcgtgccgctgaacaacaagacgtcgaacatctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatcagcaaggagcggtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacgtcgaacctgttcaacagcacgtacaacgacacctacatctccacgaactcgtccgcgaacaactcctcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacggactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagaattcggtgaccgggacctggatcc

SEQ ID NO: 344 - DNA, 1520 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggaggagatgaagaactgctccttcaacacgacgacggagatccgcgacaaggagaagaaggagcacgccctgttctaccgcccggacatcgtgccgctgaacaacgagacgggcaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcaacatccggcaggcccactgcaacatcagcgagtcgaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacggcgaagctgttcaacagcacgtacaacggcacctacatctccacgaactcgacgaactcgacgtccaagaacatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcacgacgaacaactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtgaccgggtcctggatcc

SEQ ID NO: 345 - DNA, 1517 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgacgtgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgacggtggacgagatgaagaactgctccttcaacgcgacgacggagatccgcgacaagaagaagaaggagtacgccctgttctaccgctccgacgtcgtgccgctggacgagacgaacaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccggggcacaacacgcgcaagtccgtccggatcggccctggccagaccttctacgccaccggcgacatcatcggcgacatccggcaggcccactgcaacatcaacgagtcggagtggaacgagaccctgcagaaggtgggcaaggagctgcagaagcacttccccaacaagaccatcaagtacgagcagtcggccggcggcgacatggagatcaccacgcactccttcaactgcggtggcgagttcttctactgcaacacggcggagctgttcaacggcacgtacaacggcaccgacatctccacgaactcgtcggcgaactccacgtccacgatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcatcaacaacgtctcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtcaccgggtcccggatcc

SEQ ID NO: 346 - DNA, 1517 bp, Artificial Sequence
  Description of Artificial Sequence: Synthetic polynucleotide
ggtcgacaagaagccaccatgcgcgtgacgggcatccggaagaactgcccgcagtggtggatctggggcatcctgggcttctggatgctcatgaactgcaacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgaagttcgaggagatgaagaactgctccttcaacaccacgacggagatccgcgacaaggagaagaaggagtacgccctgttctaccgccccgacatcgtgccgctggacaacgagacgtccaacatctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatctcgaaggagcggtggaacgacaccctgcagaaggtgggcaaggagctgcagaagcacttccccaacaagaccatcaagtacaaccagtcggccggcggcgacatggagatcaccacgcactccttcaactgcggtggcgagttcttctactgcaacacgtccaacctgttcaactcgacgtacaacgacacctacatctccacgaactcgaccaactccacgtcctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaaggactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtcaccaggacccggatcc

SEQ ID NO: 347 - DNA, 1592 bp, Artificial Sequence
  Description of Artificial Sequence: Synthetic polynucleotide
ggtcgacaagaagccaccatgcgcgtgacgggcatcctgaagaactgcccgctgtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtgaagaactccaccaccgaggagatgagcaacgccaccgtcaagaacagcaccacggaggagatgtccaacgccacggtgaagaactcgacgacagaggagatgaagaactgctccttcaacaccacgacggagatccgcgacaaggagaagaaggagtacgccctgttctaccgccccgacgtcgtgccgctggacgagacgaacaacacctcgaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtccggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtccaacctgttcaactcgacgtacaacgacacctacatctccccgaactcgaccaactccacgtccaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcctcgcacccaccggggccaaggagcgggtcgtggagcgcgagaaggagtagtaagaattcggtcaccaggtcccggatcc

SEQ ID NO: 348 - DNA, 1518 bp, Artificial Sequence; identical to SEQ ID NO: 332
  Description of Artificial Sequence: Synthetic polynucleotide

SEQ ID NO: 349 - DNA, 1553 bp, Artificial Sequence
  Description of Artificial Sequence: Synthetic polynucleotide
ggtcgacaagaagccaccatgcgcgtgacgggcatcctgcggaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccacggaggagatgtccaccgccctcgtgaagaactccacgaccgaggcgatgaagaactgctccttcaacaccacgacggagatccgcgacaaggagaagaaggagtacgccctgttctaccgccccgacatcgtgccgctgaacaacgagacggggaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcacctgcacacgccggtggagatcgtgtgcacccgcccgaacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtcgaagctgttcaactcgacgtacaacgacacctacatctccacgaactcgtccgccaacaactcgtccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcccggactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtcaccgggtcctggatcc

SEQ ID NO: 350 - DNA, 1517 bp, Artificial Sequence
  Description of Artificial Sequence: Synthetic polynucleotide
ggtcgacaagaagccaccatgcgcgtgacgggcatcctgaagaactacccgcagtggtggatctggggcatcctgggcttctggatgctcatgaactgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgccgctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgggccacaacacgcgcaagtccgtgcggatcggccctggccagaccttctacgccaccggcgacatcatcggcgacatccggcaggcccactgcaacatcaacgagtcgaagtggaacgagaccctgcagaaggtgggcaacgagctgcagaagcacttccccaacaagaccatcaagtacgagcaggcggccggcggcgacatggagatcaccacgcactccttcaactgcggtggcgagttcttctactgcaacacggccaacctgttcaacggcacgtacaacgggaccgacatctccacgaactcgtccgccaactcgacgtccacgatcacgctccagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtaaccgggtcccggatcc

SEQ ID NO: 351 - DNA, 1547 bp, Artificial Sequence
  Description of Artificial Sequence: Synthetic polynucleotide
ggtcgacaagaagccaccatgcgcgtgacgggcatcctgaagaactacccgcggtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccaccgaggagatgtccaacgccacggtgaagaactccacgacggaggagatgaagaactgctccttcaacaccacgacggagatccgcgacaaggagaagaaggagtacgccctgttctaccgccccgacgtcgtgccgctggacgagacgaacaacacgtccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccgctacaaccagtccgccggcggcgacatggagatcaccacgcactccttcaactgcggtggcgagttcttctactgcaacacggccaagctgttcaactccacgtacaacgacacctacaagtccacgaactcgtccgccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacaactggcgctccgagctgtacaagtacaaggtggtggaggtccagcccctgggcatcgcacccaccggggccaaggagcgggtcgtggagcgcgagaaggagtagtaagaattcggtaaccaggacccggatcc

SEQ ID NO: 352 - DNA, 1574 bp, Artificial Sequence
  Description of Artificial Sequence: Synthetic polynucleotide
ggtcgacaagaagccaccatgcgcgtgacgggcatcctgaagaactacccgcggtggtggatctggggcatcctgggcttctggatgctcatgaactgcaacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgacaccgtgaccaacatcacgaacacgatcaaggaggaggtgaagaactgctccttcaagaccacgacggagatccgcgacaaggagaagaaggagcacgccctgttctaccgccccgacatcgtgccgctgaactccgagacgggcaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagaccatcatcgtgcacctgcacacgccggtggagatcgtgtgcacccgcccgggcaacaacacgcgcaagtccatgcggatcggccctggccagaccttctacgccaccggcgacatcatcggcgacatccggcaggcccactgcaacatctcggaggagaagtggaacaagaccctgcaggaggtgggcaaggagctgcagaagcacttccccaaccggaccatcaagtacaaccagtccgccggcggcgacatggagatcaccacgcactccttcaactgcggtggcgagttcttctactgcaacacgtccaagctgttcaactccacgtacaacgacacctacatctccacgaactcgaccaactcgtccgccaacaactcgtccatcatcacgctccagtgccggatcaagcagatcatcaacatgtggcagggggtgggccgcgctatgtacgcaccgcccatcgccggcaacatcatctgcaagtccaacatcaccggcctcctgctgacccgcgacggcggcccggactcgaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaagaattcggtaaccaggtcccggatcc

SEQ ID NO: 353 - DNA, 1568 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccaacccgcaggagatgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgactccgtgaccaacatcacgaacacgatcaaggaggaggtgaagaactgctccttcaagaccacgacggagatccgcgacaaggagaagaaggagcacgccctgttctaccgccccgacatcgtgccgctcaactccgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcagctgaacacgtccgtggagatcgtgtgcacccgcccgggcaacaacacgcgcaagtccgtgcggatcggccctggccagaccttctacgccaccggcgacatcatcggcgacatccggcaggcccactgcaacatctcggagaagaagtggaacgagaccctgcagcgggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatcaacacgacctcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaagaattcggtaaccgggacctggatcc

SEQ ID NO: 354 - DNA, 1517 bp, Artificial Sequence
  Description of Artificial Sequence: Synthetic polynucleotide
ggtcgacaagaagccaccatgcgcgtgacgggcatcctgaagaactacccgcagtggtggatctggggcatcctgggcttctggatgctcatgaactgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgtccctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagacgatcatcgtgcacctgcacgccccggtggagatcgtgtgcacccgcccgggccacaacacgcgcaagtccgtgcggatcggccctggccagaccttctacgccaccggcgacatcatcggcaacatccggcaggcccactgcaacatcaacgagtcggagtggaacgagaccctgcagaaggtgggcaaggagctgcgcaagcacttccccaacaagaccatcaagtacgagcagtccgccggcggcgacatggagatcaccacgcactccttcaactgcggtggcgagttcttctactgcaacacggccaacctgttcaacggcacgtacaacgggaccgacatctccacgaactcgtccgccgaccgcaactccacgatcacgctcgagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgccacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggagtagtaagaattcggtaaccgggtcctggatcc

SEQ ID NO: 355 - DNA, 1538 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgagaactccacggaggccatgaagaactgctccttcaacaccacgacggagatccgcgacaagatcaagaaggagcgggccctgttctaccgccccgacatcgtgccgctcaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaagaattcggttaccgggtcccggatcc

SEQ ID NO: 356 - DNA, 1556 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgtccaacgtcaccgtcaacaacatcaccatcgaggagatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacgccccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgcaagatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaagaattcggttaccaggacccggatcc

SEQ ID NO: 357 - DNA, 1562 bp, Artificial Sequence
  Description of Artificial Sequence: Synthetic polynucleotide
ggtcgacaagaagccaccatgcgcgtgatgggcatcctgaagaactacccgcggtggtggatctggggcatcctgggcttctggatgctcatgatctgcaacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacgaactcgatcaactcgacgctgaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaaggagcgggtcgtggagcgcgagaaggagtagtaagaattcggttaccaggtcccggatcc

SEQ ID NO: 358 - DNA, 1556 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgaggagatcagcaacgccaccgtcaagaacatcaccatcaaggagatgaagaactgctccttcaacaccacgacggagatccgcgacaagatcaagaaggagcgggccctgttctaccgcaccgacatcgtgccgctgaacaaggagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggcaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcggcaaggagtagtaagaattcggttaccgggacctggatcc

SEQ ID NO: 359 - DNA, 1559 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgagcaacgtcaccgtcaacaacatcaccatcgaggagatgaagaactgctccttcaacaccacgacggagatccgcgacaagatcaagaaggagcgggccctgttctaccgcccggacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagaccatcatcgtgcacctgcacgccccggtggagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccaccaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcccggacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaagaattcggttaccgggtcctggatcc

SEQ ID NO: 360 - DNA, 1562 bp, Artificial Sequence
  Description of Artificial Sequence: Synthetic polynucleotide
ggtcgacaagaagccaccatgcgcgtgatgggcatcctgaagaactacccgcggtggtggatctggggcatcctgggcttctggatgctcatgatctgcaacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacgaccaagctgttcaactccacgtacaacggcacctacatctccacgaactcgatcaactcgacgctgaacatcacgctccagtgccggatcaagcagatcatcaacatgtggcaggggatcggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaaggagcgggtcgtggagcgcgggaaggagtagtaaggtgaccgggacccgaattcggatcc

SEQ ID NO: 361 - DNA, 1529 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccacggtcgagaactccacggaggccatgaagaactgctccttcaacaccacgacggagatccgcgacaagatcaagaaggagcgggccctgttctaccgccccgacatcgtgccgctcaacaacgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggaaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctccccgaactcgaccaactcgacctccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgagtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaaggtcaccgggacccgaattcggatcc

SEQ ID NO: 362 - DNA, 1538 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgggaactccacggaggccatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggagtagtaaggtaaccgggacccgaattcggatcc

SEQ ID NO: 363 - DNA, 1562 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtccggaactccacgaccgagaagatgtccgacgcgctggaccgcaactcgacgaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgccaagatcatcatcgtgcagctgaacgcgaacgcctccgtggagatcgtgtgcacccgcccgaacaacaacacgcgcaagtccgtgcggatcggccctggccagaccttctacgccaccggcgacatcatcggcgacatccggcaggcccactgcaacatctcggagaagaagtggaacgagaccctgcagcaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacggactcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgtgacggagaccttcaggccagcgggaggcgacatgcgggacaactggcgctccgagctgtacaagtacaaggtggtggagatccagcccctgggcatcgcacccaccggggccaaggagcgggtcgtggggcgcgagaaggagtagtaaggttaccgggacccgaattcggatcc

SEQ ID NO: 364 - DNA, 1524 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtgacgcggtcgaacgtgaacgtcacgaacatcacgaacacgatcaagggcgagatgaagaactgctccttcaacacgacgacggagatccgcgacaaggagaagaaggagtacgccctgttctaccgctcggacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtcgaaggagctgcagaagcacttccccaacaagacgattaagtacgcgcagtcggccggcggcgacatggagatcaccacgcactccttcaactgcggtggcgagttcttctactgcaacacgtcgaacctgttcaacggcacctacaacggcacctacatctcgacgaactcgtccgcgaactccaacagcacgatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcaccaagaacaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 365 - DNA, 1488 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccatgggggagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacggcaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcggcatcatcggcgacatccgccaggcccactgcaacatcagcgaggggcagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacggcacgtacaacggcacctacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 366 - DNA, 1545 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgactacgacacgcggtccaacgtgaacgtgaccaacatcacgaacacgatcaagggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgagtcgaagtggaacgagaccctgcagaaggtgggcatcgagctgcagaagcacttccccaacaagacgattaagtacgagcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctccgaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 367 - DNA, 1551 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcatcgagctgcagaagcacttccccaacaagacgattaagtacgagcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaccagcaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 368 - DNA, 1497 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggacaaccgcaccgtcggggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgaggagaagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccaccaactcgaaccccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 369 - DNA, 1497 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagtccaagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggcgaagctgttcaacgggacgtacaacggcacggacatctccacgaactcctcgacgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcgggaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 370 - DNA, 1500 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaacacgtcgaacctgttcaacggcacgtacaacggcaccgacatctcgacgaactcgtccgcgaagtcgaactcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaactcgtcgaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 371 - DNA, 1503 bp, Artificial Sequence
  Description of Artificial Sequence: Synthetic polynucleotide
gtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtggacaactcgacggtggaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgagatccgccaggcccactgcaacatcagcgaggaggagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaacacggccaacctgttcaacgggacgtacaacggcaccgacatctccacgaactcctcgacgaagtcgaactcgacgatcacgctccagtgccgcatcaagcagatcatcaacatgtggcagggggtgggccgcgctatgtacgcaccgcccatcgccggcaacatcacctgcaagtccaacgtgaccggcctcctgctgacccgcgacggcggcaccaactcgtcgcagaccgaggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 372 - DNA, 1488 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacgcgcccgtggagatcgtgtgcacccgcccgaacaacgacacgcgcaagtccgtccggatcggccctggccagaccttctacgccaccggcgacatcatcggcgacatccggcaggcccactgcaacatcagcgagaaggagtggaacgagaccctgcagaaggtgggcatcgagctgcagaagcacttccccaacaagaccattaagtacgagcagtcggccggcggcgacatggagatcaccacgcactccttcaactgcggtggcgagttcttctactgcaacacgtcgaagctgttcaacggcacgtacaacggcacctacatcaacacgtcgtcgaactcgacgatcacgctccagtgccgcatcaagcagatcatcaacatgtggcagggggtgggccgcgctatgtacgcaccgcccatcgccggcaacatcacctgcaagtccgacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 373 - DNA, 1497 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacacggtcaacaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgagaaggagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggccaacctgttcaacggcacgtacaacggcaccgacatctcgacgaactcctcgacgaagtcgaactcgacgatcacgctccagtgccgcatcaagcagatcatcaacatgtggcagggggtgggccgcgctatgtacgcaccgcccatcgccggcaacatcacctgccgctccacgatcaccggcctcctgctgacccgcgacggcggcaactcgtcgaagaccgaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 374 - DNA, 1497 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacacggtcaacaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgaggaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacggccaagctgttcaacgggacgtacaacggcacggacatctccacgaactcctcgacgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaactcgtcgaagacggaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 375 - DNA, 1491 bp, Artificial Sequence
  Description of Artificial Sequence: Synthetic polynucleotide
gtcgacaagaagccaccatgcgcgtgatgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaacaagacggtggaggagatgaagaactgctccttcaacacgacgacggagatccgcgacaaggagaagaaggagtacgccctgttctacaagccggacgtcgtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 376 - DNA, 1491 bp, Artificial Sequence
  Description of Artificial Sequence: Synthetic polynucleotide
gtcgacaagaagccaccatgcgcgtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaacgggacggtggaggagatgaagaactgctccttcaacacgacgacggagatccgcgacaaggagaagaaggagtacgccctgttctacaagccggacatcgtgccgctgtcggagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 377 - DNA, 1494 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgcggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 378 - DNA, 1494 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgcccgcgcctacgagaaggaggtgcacaacgtgtgggcgacccacgcctgcgtgcccacggaccccaacccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccataaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgccgactcgaacagcacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcgagaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 379 - DNA, 1494 bp, Artificial Sequence
  Description of Artificial Sequence: Synthetic polynucleotide
gtcgacaagaagccaccatgcgggtgatgggcatccccaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccaacccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgccgactcgaacagcacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcgagaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 380 - DNA, 1494 bp, Artificial Sequence
  Description of Artificial Sequence: Synthetic polynucleotide
gtcgacaagaagccaccatgcgggtgatgggcatcctcaagaactacccgcagtggtggatctggggcatcctgggcttctggatgctcatgatctgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacctcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgcagaagcacttccccaacaagaccattaagtacaagcactcggccggcggcgacatggagatcaccacgcactccttcaactgcggtggcgagttcttctactgcaacacgtcgaacctgttcaacggcacgtacaacggcacctacatgaacatctcgacggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 381 - DNA, 1497 bp, Artificial Sequence
  Description of Artificial Sequence: Synthetic polynucleotide
gtcgacaagaagccaccatgcgcgtgatgggcatccccaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtgaacaagtccacggtggaggagatgaagaactgctccttcaacacgacgacggagatccgcgacaaggagaagaaggagtacgccctgttctaccgcccggacatcgtgccgctgaacaacaagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggaggaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcggcatcatcggcgacgtgcgccaggcccactgcaacatcagcaagggcctctggaacgacaccctgcagaaggtgggcaaggagctgcagaagcacttccccaacaagaccattcgctacaaccagtcggccggcggcgacatggagatcaccacgcactccttcaactgcggtggcgagttcttctactgcaacacggccaagctgttcaacgggacgtacaacggcaccgacatctccacgaactcctcggcgaacaactcgtccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaactcgtcgcgcgaggaggagatcttcaggccagcgggaggcgacatgcgcgacaactggcgctccgagctgtacaagtacaaggtggtggaggtgcagcccctgggcatcgcacccaccggggccaaggagcgggtcgtggagcgcgagaaggagtagtaagggatcc

SEQ ID NO: 382 - DNA, 1497 bp, Artificial Sequence
  Description of Artificial Sequence: Synthetic polynucleotide
gtcgacaagaagccaccatgcgcgtgatgggcatccccaagaactacccgcgctggtggatctggggcatcctgggcttctggatgctcatgatctgcaacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggacgagatgaagaactgctccttcaacacgacgacggagatccgcgacaaggagaagaaggagcgcgccctgttctaccgcccggacatcgtgccgctgaacaacgagacgggcaacacctcggagtacaggctgatcaactgcaacacctccgcgatcacgcaggcgtgccccaaggtcacgttcgagcccatccccatccactactgcgcccccgccggctacgccatcctgaagtgcaacgacgagaccttcaacgggaccggcccgtgcagctcggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgaacgcctccgtggagatcgtgtgcacccgcccgaacaacaacacgcgcaagtccgtccggatcggccctggccagaccttctacgccaccggcgacatcatcggcgacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggagtagtaagggatcc

SEQ ID NO: 383 - DNA, 1497 bp, Artificial Sequence
  Description of Artificial Sequence: Synthetic polynucleotide
gtcgacaagaagccaccatgcgcgtgatgggcatccccaagaactacccgcgctggtggatctggggcatcctgggcttctggatgctcatgatctgcaacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggacgagatgaagaactgctccttcaacacgacgacggagatccgcgacaaggagaagaaggagcgcgccctgttctaccgcccggacatcgtgccgctgaacaacgagacgggcaacacctcggagtacaggctgatcaactgcaacacctccgcgatcacgcaggcgtgccccaaggtcacgttcgagcccatccccatccactactgcgcccccgccggctacgccatcctgaagtgcaacgacgagaccttcaacgggaccggcccgtgcagctcggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgaacgcctccgtggagatcgtgtgcacccgcccgaacaacaacacgcgcaagtccgtccggatcggccctggccagaccttctacgccaccggcgacatcatcggcgacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggagtagtaagggatcc

SEQ ID NO: 384 - DNA, 1497 bp, Artificial Sequence
  Description of Artificial Sequence: Synthetic polynucleotide
gtcgacaagaagccaccatgcgcgtgatgggcatccccaagaactacccgcgctggtggatctggggcatcctgggcttctggatgctcatgatctgcaacggcgtgccggtgtggaaggaggccaagacgaccctgttctgcgcgtcggacgccaaggcctacgtgaaggaggtgcacaacatctgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaaccagtccacgacggaggagatgaagaactgctccttcaacacgacgacggagatccgcgacaaggagaagaaggagcacgccctgttctaccgcccggacatcgtgccgctggacaacgagacgggcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcgtgcggtccgagaacctcacgaacaacgcgaagatcatcatcgtgcagctgaacgcctccgtggagatcgtgtgcacccgcccgaacaacaacacgcgcaagtccgtccggatcggccctggccagaccttctacgccaccggcgacatcatcggcaacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggagtagtaagggatcc

SEQ ID NO: 385 - DNA, 1542 bp, Artificial Sequence
  Description of Artificial Sequence: Synthetic polynucleotide
gtcgacaagaagccaccatgcgcgtgatgggcatcccgaagaactacccgctctggtggatctggggcatcctgggcttctggatgctcatgaactgcaacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagatctcccacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacgaactcgatcaactcgacgctgaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactccaacgtgacggagaccttcaggccagcgggaggcgacatgcgggacaactggcgctccgagctgtacaagtacaaggtggtggagatccagcccctgggcatcgcacccaccggggccaaggagcgggtcgtggagcgcgggaaggagtagtaagggatcc

SEQ ID NO: 386 - DNA, 1533 bp, Artificial Sequence
  Description of Artificial Sequence: Synthetic polynucleotide
gtcgacaagaagccaccatgcgcgtgatgggcatcctcaagaactacccgcagtggtggatctggggcatcctgggcttctggatgctcatgaactgcaacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtgaagaactcgacgaccgaggagatgtccaacgccacggtgaagaactcgacgacggaggagatgaagaactgctccttcaacacgacgacggagatccgcgacaaggagaagaaggagtacgccctgttctaccgcccggacgtggtcccgctggacgagacgaacaacacctcgaagtacaggctgatcaactgcaacacctccgcggtgacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagacgatcatcgtgcacctgcacaccccggtggagatcgtgtgcacccgcccgtacaacaacacgcgcaagtccgtccggatcggccctggccagaccttctacgccaccggcgacatcatcggcgacccgcgccaggcccactgcaacatcagcaaggagacctggaacaagaccctgcaggaggtgggcaaggagctgcagaagcacttccccaacaagaccattcgctacaaccagtcggccggcggcgacatggagatcaccacgcactccttcaactgcggtggcgagttcttctactgcaacacgtccaacctgttcaactcgacgtacaacgacacctacatctccccgaactccaccaactcgacctcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggaggtccagcccctgggcctcgcacccaccggggccaaggagcgggtcgtggagcgcgagaaggagtagtaagggatcc

SEQ ID NO: 387 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTHSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 388 - protein, 503 aa, Artificial Sequence
  Description of Artificial Sequence: Synthetic polypeptide
MRVMGILKNYPQWWIWGILGFWMLMICNGVPVWKEAKTTLFCASNAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 389 - protein, 9 aa, Artificial Sequence
  Description of Artificial Sequence: Synthetic peptide
  MOD_RES (9)..(9): Any amino acid
GDRIRDPDX

SEQ ID NO: 390 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 391 - protein, 10 aa, Artificial Sequence
  Description of Artificial Sequence: Synthetic peptide
  MOD_RES (9)..(10): Any amino acid
GHRIRDPDXX

SEQ ID NO: 392 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 393 - protein, 10 aa, Artificial Sequence
  Description of Artificial Sequence: Synthetic peptide
  MOD_RES (9)..(10): Any amino acid
GNRIRDPDXX

SEQ ID NO: 394 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWSKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 395 - protein, 9 aa, Artificial Sequence
  Description of Artificial Sequence: Synthetic peptide
  MOD_RES (9)..(9): Any amino acid
GYRIRDPDX

SEQ ID NO: 396 - protein, 503 aa, Artificial Sequence; identical to SEQ ID NO: 284
  Description of Artificial Sequence: Synthetic polypeptide

SEQ ID NO: 397 - protein, 9 aa, Artificial Sequence
  Description of Artificial Sequence: Synthetic peptide
  MOD_RES (9)..(9): Any amino acid
GDRIRVPDX

SEQ ID NO: 398 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELGLENVTENFNMWKNDMVDQMHEDIISLWDQSLKPCVKLTPLCVTLKCSNAIVDSSKVYDTRSKVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 399 - protein, 9 aa, Artificial Sequence
  Description of Artificial Sequence: Synthetic peptide
  MOD_RES (9)..(9): Any amino acid
GDRIQDPDX

SEQ ID NO: 400 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 401 - protein, 9 aa, Artificial Sequence
  Description of Artificial Sequence: Synthetic peptide
  MOD_RES (9)..(9): Any amino acid
GDRIQVPDX

SEQ ID NO: 402 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGHITCKSNITGLLLTRDGGTKNNSNETEETFRPAGGDMRDNWRSELYKYKVVEIQPLGIAPTGAKERVVEREKE

SEQ ID NO: 403 - protein, 9 aa, Artificial Sequence
  Description of Artificial Sequence: Synthetic peptide
  MOD_RES (9)..(9): Any amino acid
GDRIRDLDX

SEQ ID NO: 404 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 405 - protein, 9 aa, Artificial Sequence
  Description of Artificial Sequence: Synthetic peptide
  MOD_RES (9)..(9): Any amino acid
GDRIRVLDX

SEQ ID NO: 406 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 407 - protein, 10 aa, Artificial Sequence
  Description of Artificial Sequence: Synthetic peptide
  MOD_RES (9)..(10): Any amino acid
GHRIRVPDXX

SEQ ID NO: 408 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 409 - protein, 9 aa, Artificial Sequence
  Description of Artificial Sequence: Synthetic peptide
  MOD_RES (9)..(9): Any amino acid
GHRIQDPDX

SEQ ID NO: 410 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 411 - protein, 9 aa, Artificial Sequence
  Description of Artificial Sequence: Synthetic peptide
  MOD_RES (9)..(9): Any amino acid
GHRIQVPDX

SEQ ID NO: 412 - protein, 507 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVIENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 413 - protein, 9 aa, Artificial Sequence
  Description of Artificial Sequence: Synthetic peptide
  MOD_RES (9)..(9): Any amino acid
GHRIRDLDX

SEQ ID NO: 414 - protein, 503 aa, Artificial Sequence
  Description of Artificial Sequence: Synthetic polypeptide
MKVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSSITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 415 - protein, 9 aa, Artificial Sequence
  Description of Artificial Sequence: Synthetic peptide
  MOD_RES (9)..(9): Any amino acid
GHRIRVLDX

SEQ ID NO: 416 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 417 - protein, 10 aa, Artificial Sequence
  Description of Artificial Sequence: Synthetic peptide
  MOD_RES (9)..(10): Any amino acid
GNRIRVPDXX

SEQ ID NO: 418 - protein, 503 aa, Artificial Sequence
  Description of Artificial Sequence: Synthetic polypeptide
MRVMGIPKNYPQWWIWGILGFWMLMICNGVPVWKEAKTTLFCASDAKAYEKEVHNVWATHACVPTDPSPQELVLENVTENFNMWKNDMVDQMHEDIISLWDQSLKPCVKLTPLCVTLNCSNAIVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGARERVVEREKE

SEQ ID NO: 419 - protein, 9 aa, Artificial Sequence
  Description of Artificial Sequence: Synthetic peptide
  MOD_RES (9)..(9): Any amino acid
GNRIQDPDX

SEQ ID NO: 420 - protein, 503 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLKNVTENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 421 - protein, 9 aa, Artificial Sequence
  Description of Artificial Sequence: Synthetic peptide
  MOD_RES (9)..(9): Any amino acid
GNRIQVPDX

SEQ ID NO: 422 - protein, 503 aa, Artificial Sequence
  Description of Artificial Sequence: Synthetic polypeptide
MRVMGIPKNYPQWWIWGILGFWILMICNGVPVWKEAKTTLFCASDAKAYEKEVHNVWATHACVPTDPSPQELVLKNVTENFNMWKNDMVDQMHEDIISLWDQSLKPCVKLTPLCVTLNCNSATVDNSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNDKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 423 - protein, 9 aa, Artificial Sequence
  Description of Artificial Sequence: Synthetic peptide
  MOD_RES (9)..(9): Any amino acid
GNRIRDLDX

SEQ ID NO: 424 - protein, 507 aa, Artificial Sequence
  Description of Artificial Sequence: Synthetic polypeptide
MRVRGILKNYPQWWIWGILGFWMLMICNGVPVWKEAKTTLFCASDAKAYEKEVHNVWATHACVPTDPSPQELVLENVIENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 425 - protein, 9 aa, Artificial Sequence
  Description of Artificial Sequence: Synthetic peptide
  MOD_RES (9)..(9): Any amino acid
GNRIRVLDX

SEQ ID NO: 426 - protein, 503 aa, Artificial Sequence
  Description of Artificial Sequence: Synthetic polypeptide
MRVMGILKNYLQWWIWGILGFWMLMICKGVPVWKEAKTTLFCASDAKAYEKEVHNVWATHACVPTDPSPQELVLENVIENFNMWKNDMVDQMHEDIISLWDQSLKPCVKLTPLCVTLTCSNATVDNSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWYKTLQEVGKELQKHFPNKTIKYERSAGGDMEIATHSFNCGGEFFYCNTSNLFNGTYNGTYISINSTSYITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKE

SEQ ID NO: 427 - protein, 10 aa, Artificial Sequence
  Description of Artificial Sequence: Synthetic peptide
  MOD_RES (9)..(10): Any amino acid
GYRIRVPDXX

SEQ ID NO: 428 - protein, 493 aa, Artificial Sequence
  Description of Artificial Sequence: Synthetic polypeptide
MKVMGILKNYPQWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEGQWNKTLQEVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 429 - protein, 9 aa, Artificial Sequence
  Description of Artificial Sequence: Synthetic peptide
  MOD_RES (9)..(9): Any amino acid
GYRIQDPDX

SEQ ID NO: 430 - protein, 491 aa, Artificial Sequence
  Description of Artificial Sequence: Synthetic polypeptide
MRVMGIPKNYPQWWIWGILGFWMLMICNGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 431 - protein, 9 aa, Artificial Sequence
  Description of Artificial Sequence: Synthetic peptide
  MOD_RES (9)..(9): Any amino acid
GYRIQVPDX

SEQ ID NO: 432 - protein, 493 aa, Artificial Sequence
  Description of Artificial Sequence: Synthetic polypeptide
MRVMGILKNYPQWWIWGILGFWMLMNCNGVPVWKEAKTTLFCASDAKAYKKEVHNVWATHACVPTDPSPQELVLENVTENFNMWKNDMVDQMHEDIISLWDQSLKPCVKLTPLCVTLNCSNARSNVNVTSINNTIMGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 433 - protein, 9 aa, Artificial Sequence
  Description of Artificial Sequence: Synthetic peptide
  MOD_RES (9)..(9): Any amino acid
GYRIRDLDX

SEQ ID NO: 434 - protein, 491 aa, Artificial Sequence
  Description of Artificial Sequence: Synthetic polypeptide
MRVMGILKNYPRWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQEVGKELQKHFPNKTIKYERSAGGDMEIATHSFNCGGEFFYCNTSNLFNGTYNGTDISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 435 - protein, 9 aa, Artificial Sequence
  Description of Artificial Sequence: Synthetic peptide
  MOD_RES (9)..(9): Any amino acid
GYRIRVLDX

SEQ ID NO: 436 - protein, 490 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLDNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSKLFNGTYNGTYISTNSTSYITLQCRIKQIINMWQGVGRAMYAPPIAGNITCKSNITGLLLTRDGGTNNNSNEETFRPAGGDMRDNWRSELYKYKVVEIQPLGIAPTGAKERVVEREKE

SEQ ID NO: 437 - protein, 5 aa, Artificial Sequence
  Description of Artificial Sequence: Synthetic peptide
GTRIR

SEQ ID NO: 438 - protein, 492 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQEVGKELQKHFPNKTIKYERSAGGDMEITTHSFNCGGEFFYCNTSNLFNGTYNGPYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 439 - protein, 10 aa, Artificial Sequence
  Description of Artificial Sequence: Synthetic peptide
  MOD_RES (9)..(10): Any amino acid
GTRIRSPDXX

SEQ ID NO: 440 - protein, 492 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLKNVTENFNMWKNDMVDQMHEDIISLWDQSLKPCVKLTPLCVTLDCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSNLFNGTYNGTYINISTNSNSTITLQCRIKQIINMWQGVGRAMYAPPIAGNITCRSNITGLLLTRDGGTKNNSNEETFRPAGGDMRDNWRSELYKYKVVEIQPLGIAPTGAKERVVEREKE

SEQ ID NO: 441 - protein, 5 aa, Artificial Sequence
  Description of Artificial Sequence: Synthetic peptide
GTRIR

SEQ ID NO: 442 - protein, 489 aa, Artificial Sequence
  Description of Artificial Sequence: Synthetic polypeptide
MRVMGILKNYPQWWIWGILGFWMLMICKGVPVWKEAKTTLFCASDAKAYEKEMHNVWATHACVPTDPSPQELFLENVTENFNMWKNDMVDQMHEDIISLWDQSLKPCVKLTPLCVTLNCSNVSNVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEIATHSFNCGGEFFYCNTSNLFNGTYNGTYSTNSTSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 443 - protein, 9 aa, Artificial Sequence
  Description of Artificial Sequence: Synthetic peptide
  MOD_RES (9)..(9): Any amino acid
GTRIRLPDX

SEQ ID NO: 444 - protein, 494 aa, Artificial Sequence
  Description of Artificial Sequence: Synthetic polypeptide
MRVMGILKNYPPWWIWGILGFWMLMICNGVPVWKEAKTTLFCASDARAYEKEVHNVWATHACVPTDPSPQELVLGNVTENFNMWKNDMVDQMHEDIISLWDQSLKPCVKLTPLCVTLNCSNVNVVNVTNITNTIKGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSNLFNGTYNGTYISTNSSANSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKE

SEQ ID NO: 445 - protein, 5 aa, Artificial Sequence
  Description of Artificial Sequence: Synthetic peptide
GSRIR

SEQ ID NO: 446 - protein, 503 aa, Artificial Sequence
  Description of Artificial Sequence: Synthetic polypeptide
MKVMGILKNYPQWWIWGILGFWMLMICKGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKERVVEREKE

SEQ ID NO: 447 - protein, 9 aa, Artificial Sequence
  Description of Artificial Sequence: Synthetic peptide
EDPNSVTGS

SEQ ID NO: 448 - protein, 494 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKE

SEQ ID NO: 449 - protein, 9 aa, Artificial Sequence
  Description of Artificial Sequence: Synthetic peptide
EVPNSVTGS

SEQ ID NO: 450 - protein, 494 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGKYINISTNSNSTITLQCRIKQIINMWQGVGRAMYAPPIAGNITCKSNITGLLLTRDGGTKNNSTETEETFRPAGGDMRDNWRSELYKYKVVEIQPLGIAPTGAKERVVEREKE

SEQ ID NO: 451 - protein, 503 aa, Artificial Sequence
  Description of Artificial Sequence: Synthetic polypeptide
MRVMGILKNCPQWWIWGILGFWMLMICNGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYDTRSNVSVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPSNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYTNISTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKE

SEQ ID NO: 452 - protein, 486 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLKNVTENFNMWKNDMVDQMHEDIISLWDQSLKPCVKLTPLCVTLNCVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYNGSTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKE

SEQ ID NO: 453 - protein, 9 aa, Artificial Sequence
  Description of Artificial Sequence: Synthetic peptide
  MOD_RES (9)..(9): Any amino acid
GSRIRSPDX

SEQ ID NO: 454 - protein, 501 aa, Artificial Sequence
  Description of Artificial Sequence: Synthetic polypeptide
MRVMGIPKNYPQWWIWGILGFWMLMNCNGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTVYDTRSNANVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKE

SEQ ID NO: 455 - protein, 9 aa, Artificial Sequence
  Description of Artificial Sequence: Synthetic peptide
EDPNSVTGS

SEQ ID NO: 456 - protein, 501 aa, Artificial Sequence
  Description of Artificial Sequence: Synthetic polypeptide
MRVMGIPKNYPQWWIWGILGFWMLMICSGVPVWKEAKTTLFCASDAKAYEKEMHNVWATHACVPTDPSPQELFLENVTENFNMWKNDMVDQMHEDIISLWDQSLKPCVKLTPLCVTLICSNATVNNRTVYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSKLFNGTYNGINISTNSNSTITLQCRIKQIINMWQGVGRAMYAPPIAGNITCKSNITGLLLTRDGGNRNNSNEETFRPAGGDMRDNWRSELYKYKVVEIQPLGIAPTGAKERVVEREKE

SEQ ID NO: 457 - protein, 9 aa, Artificial Sequence
  Description of Artificial Sequence: Synthetic peptide
EVPNSVTGS

SEQ ID NO: 458 - protein, 485 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYEMKNCSFNTTTEIRDKEKKEYALFYRPDIVPLGETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKE

SEQ ID NO: 459 - protein, 6 aa, Artificial Sequence
  Description of Artificial Sequence: Synthetic peptide
  MOD_RES (6)..(6): Any amino acid
IRSPDX

SEQ ID NO: 460 - protein, 485 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELFLENVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGAIIGDIRQAHCNISESKWNETLQKVGKELQKHFPNKTIKYEQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKE

SEQ ID NO: 461 - protein, 6 aa, Artificial Sequence
  Description of Artificial Sequence: Synthetic peptide
  MOD_RES (6)..(6): Any amino acid
IRSPDX

SEQ ID NO: 462 - protein, 486 aa, Artificial Sequence
  Description of Artificial Sequence: Synthetic polypeptide
MKVMGIPKNYPQWWIWGILGFWMLMNCNGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSKLFNGTYNGTDISTNSSANSNSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKE

SEQ ID NO: 463 - protein, 5 aa, Artificial Sequence
  Description of Artificial Sequence: Synthetic peptide
GSRIR

SEQ ID NO: 464 - protein, 485 aa, Artificial Sequence
  Description of Artificial Sequence: Synthetic polypeptide
MRVMGILKNCPQWWIWGILGFWMLMICNGVPVWKEAKTTLFCASDARAYEKEVHNVWATHACVPTDPSPQELVLDNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNKTFNGTGPCSKVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKE

SEQ ID NO: 465 - protein, 9 aa, Artificial Sequence
  Description of Artificial Sequence: Synthetic peptide
EDPNSVTGS

SEQ ID NO: 466 - protein, 486 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELVLKNVTENFNMWKNNRVDQMHEDIISLWDQSLKPCVKLTPLCVTLICSNATVDNRTVGEMKNCSFNTTTEIRDKEKKEYALFYKPDVVPLDETNNTSEYRLINCNTSAVTQACPKVTFEPIPIHYCAPAGYAILKCNNETFNRTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKE

SEQ ID NO: 467 - protein, 9 aa, Artificial Sequence
  Description of Artificial Sequence: Synthetic peptide
EVPNSVTGS

SEQ ID NO: 468 - protein, 503 aa, Artificial Sequence
  Description of Artificial Sequence: Synthetic polypeptide
MRVTGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERPAGGDLEITTHSFNCGGEFFYCNTSKLFNGTYNGTDISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKE

SEQ ID NO: 469 - protein, 507 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKERVVEREKE

SEQ ID NO: 470 - protein, 488 aa, Artificial Sequence
  Description of Artificial Sequence: Synthetic polypeptide
MRVMGILKNYPQWWIWGILGFWMLMICKGVPVWKEAKTTLFCASDAKAYEKEVHNVWATHACVPTDPSPQELFLENVTENFNMWKNDMVDQMHEDIISLWDQSLKPCVKLTPLCVTLICSNATVNNRTVYEMKNCSFNTTTEIRDKEKKEYALFYRSDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGEIRQAHCNISESKWNETLQKVGKELQKHFPNKTIKYERSAGGDMEITTHSFNCGGEFFYCNTSKLFNGTYNGTDISTNSSANSNSTITLQCRIKQIINIWQGVGRAMYAPPIAGNITCKSNITGLLLTRDGGNNNNRNEETFRPAGGDMRDNWRSELYKYKVVEIQPLGIAPTGAKERVVEREKE

SEQ ID NO: 471 - protein, 10 aa, Artificial Sequence
  Description of Artificial Sequence: Synthetic peptide
  MOD_RES (9)..(10): Any amino acid
GSRIRLPDXX

SEQ ID NO: 472 - protein, 489 aa, Artificial Sequence
  Description of Artificial Sequence: Synthetic polypeptide
MRVMGIPKNYPQWWIWGILGFWMLMNCNGVPVWKEAKTTLFCASDARAYEKEVHNVWATHACVPTDPSPQELVLGNVTENFNMWKNDMVDQMHEDIISLWDQSLKPCVKLTPLCVTLICSNATVDNRTVGEMKNCSFNTTTEIRDKEKKEYALFYRPDIVPLSETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGEIKQAHCNISEEKWNETLQKVGKELQKHFPNKIIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGTNSSKTEEETFRPAGGDMRDNWRSELYKYKVVEIQPLGIAPTGAKERVVEREKE

SEQ ID NO: 473 - protein, 9 aa, Artificial Sequence
  Description of Artificial Sequence: Synthetic peptide
EDPNSVTGS

SEQ ID NO: 474 - protein, 488 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKERVVEREKE

SEQ ID NO: 475 - protein, 9 aa, Artificial Sequence
  Description of Artificial Sequence: Synthetic peptide
EVPNSVTGS

SEQ ID NO: 476 - protein, 489 aa, Artificial Sequence
  Description of Artificial Sequence: Synthetic polypeptide
MRVMGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYEQSAGGDMEITTHSFNCGGEFFYCTTSKLFNGTYNGTDISTNSSANSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKE

SEQ ID NO: 477 - protein, 6 aa, Artificial Sequence
  Description of Artificial Sequence: Synthetic peptide
  MOD_RES (6)..(6): Any amino acid
IRLPDX

SEQ ID NO: 478 - protein, 491 aa, Artificial Sequence
  Description of Artificial Sequence: Synthetic polypeptide
MRVTGILKNYPQWWIWGILGFWMLMNCNGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTVDEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNNSSKTEEETFRPAGGDMRDNWRSELYKYKVVEIQPLGIAPTGAKERVVEREKE

SEQ ID NO: 479 - protein, 6 aa, Artificial Sequence
  Description of Artificial Sequence: Synthetic peptide
  MOD_RES (6)..(6): Any amino acid
IRLPDX

SEQ ID NO: 480 - protein, 489 aa, Artificial Sequence
  Description of Artificial Sequence: Synthetic polypeptide
MRVMGIPKNCPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEEEEIFRPAGGDMRDNWRSELYKYKVVEIQPLGIAPTGAKERVVEREKE

SEQ ID NO: 481 - protein, 9 aa, Artificial Sequence
  Description of Artificial Sequence: Synthetic peptide
  MOD_RES (9)..(9): Any amino acid
EFGDRDPDX

SEQ ID NO: 482 - protein, 488 aa, Artificial Sequence
  Description of Artificial Sequence: Synthetic polypeptide
MRVTGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDTRQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKE

SEQ ID NO: 483 - protein, 9 aa, Artificial Sequence
  Description of Artificial Sequence: Synthetic peptide
  MOD_RES (9)..(9): Any amino acid
EFGHRDPDX

SEQ ID NO: 484 - protein, 487 aa, Artificial Sequence
  Description of Artificial Sequence: Synthetic polypeptide
MRVTGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSHATVENSTTEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIIGEIRQAHCNISKETWNDTLQKVGKELQKHFPNKTIRYNQSAGGDMEITTHSFNCGGEFFYCNTAKLFNSTYNGTYISTNSTNSTSYITLQCRIKQIINMWQGVGRAMYAPPIAGNITCRSNITGLLLTRDGGTNSSEEEIFRPAGGDMRDNWRSELYKYKVVEVQPLGIAPTGAKERVVEREKE

SEQ ID NO: 485 - protein, 10 aa, Artificial Sequence
  Description of Artificial Sequence: Synthetic peptide
  MOD_RES (9)..(10): Any amino acid
EFGNRDPDXX

SEQ ID NO: 486 - protein, 489 aa, Artificial Sequence
  Description of Artificial Sequence: Synthetic polypeptide
MRVTGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKERVVEREKE

SEQ ID NO: 487 - protein, 9 aa, Artificial Sequence
  Description of Artificial Sequence: Synthetic peptide
  MOD_RES (9)..(9): Any amino acid
EFGYRDPDX

SEQ ID NO: 488 - protein, 490 aa, Artificial Sequence
  Description of Artificial Sequence: Synthetic polypeptide
MRVMGILKNYPRWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSTATVNKSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIVGDIRQAHCNISKGLWNDTLQKVGIELQKHFPNKTIKYNQSAGGDMEITTHSFNCGGEFFYCNTSNLFNGTYNGTYISTNSSANSTSYITLQCRIKQIINMWQGVGRAMYAPPIAGNITCRSNITGLLLTRDGGTTNNSNETETFRPAGGDMRDNWRSELYKYKVVEIQPLGIAPTGAKERVVEREKE

SEQ ID NO: 489 - protein, 9 aa, Artificial Sequence
  Description of Artificial Sequence: Synthetic peptide
  MOD_RES (9)..(9): Any amino acid
EFGDRVPDX

SEQ ID NO: 490 - protein, 489 aa, Artificial Sequence
  Description of Artificial Sequence: Synthetic polypeptide
MRVTGILKNYPRWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSNAIVENGTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGDPRQAHCNISKEKWNDTLQKVGKELQKHFPNKTIRYNQSAGGDMEITTHSFNCGGEFFYCNTAKLFNSTYNGTYISTNSTNSTSNITLQCRIKQIINMWQGVGRAMYAPPIAGNITCRSNITGLLLTRDGGTTNNSNETETFRPAGGDMRDNWRSELYKYKVVEIQPLGIAPTGAKERVVEREKE

SEQ ID NO: 491 - protein, 9 aa, Artificial Sequence
  Description of Artificial Sequence: Synthetic peptide
  MOD_RES (9)..(9): Any amino acid
EFGDQDPDX

SEQ ID NO: 492 - protein, 489 aa, Artificial Sequence
  Description of Artificial Sequence: Synthetic polypeptide
MRVMGIQKNYPRWWIWGILGFWMLMICNGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTTEEMKNCSFNTTTEIRDKEKKEHALFYRPDIVPLNNETGNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSKLFNSTYNGTYISTNSTNSTSYITLQCRIKQIINMWQGVGRAMYAPPIAGNITCRSNITGLLLTRDGGINNDSNETETFRPAGGDMRDNWRSELYKYKVVEIQPLGIAPTGAKERVVEREKE

SEQ ID NO: 493 - protein, 9 aa, Artificial Sequence
  Description of Artificial Sequence: Synthetic peptide
  MOD_RES (9)..(9): Any amino acid
EFGDQVPDX

SEQ ID NO: 494 - protein, 488 aa, Artificial Sequence
  Description of Artificial Sequence: Synthetic polypeptide
MRVTGILKNYPRWWIWGILGFWMLMICNGVPVWKEAKTTLFCASDARAYEKEVHNVWATHACVPTDPSPQELVLDNVTENFNMWKNDMVDQMHEDIISLWDQSLKPCVKLTPLCVTLICSIATANGSTVEEMKNCSFNTTTEIRDKEKKEYALFYRPDIVPLNNKTSNISEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIRYNQSAGGDMEITTHSFNCGGEFFYCNTSNLFNSTYNDTYISTNSSANNSSTITLQCRIKQIINMWQGVGRAMYAPPIAGNITCKSNITGLLLTRDGGTDSNETETFRPAGGDMRDNWRSELYKYKVVEIQPLGIAPTGAKERVVEREKE

SEQ ID NO: 495 - protein, 9 aa, Artificial Sequence
  Description of Artificial Sequence: Synthetic peptide
  MOD_RES (9)..(9): Any amino acid
EFGDRDLDX

SEQ ID NO: 496 - protein, 490 aa, Artificial Sequence
  Description of Artificial Sequence: Synthetic polypeptide
MRVTGILKNYPRWWIWGILGFWMLMICNGVPVWKEAKTTLFCASDAKAYVKEVHNVWATHACVPTDPSPQELVLDNVTENFNMWKNDMVDQMHEDIISLWDQSLKPCVKLTPLCVTLICSNATVENSTTEEMKNCSFNTTTEIRDKEKKEHALFYRPDIVPLNNETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPNNNTRKSVRIGPGQTFYATGDIIGNIRQAHCNISESKWNDTLQKVGIELQKHFPNKTIKYNQSAGGDMEITTHSFNCGGEFFYCNTAKLFNSTYNGTYISTNSTNSTSKNITLQCRIKQIINMWQGVGRAMYAPPIAGNITCRSNITGLLLTRDGGTTNNSNETETFRPAGGDMRDNWRSELYKYKVVEVQPLGIAPTGAKERVVEREKE

SEQ ID NO: 497 - protein, 9 aa, Artificial Sequence
  Description of Artificial Sequence: Synthetic peptide
  MOD_RES (9)..(9): Any amino acid
EFGDRVLDX

SEQ ID NO: 498 - protein, 489 aa, Artificial Sequence
  Description of Artificial Sequence: Synthetic polypeptide
MRVTGILKNYPQWWIWGILGFWMLMTCNGVPVWKEAKTTLFCASDAKAYKKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESEWNETLQKVGKELQKHFPNKTIKYEQSAGGDMEITTHSFNCGGEFFYCNTAELFNGTYNGTDISTNSSANSTSTITLQCRIKQIINMWQGVGRAMYAPPIAGNITCRSNITGLLLTRDGGINNVSNETETFRPAGGDMRDNWRSELYKYKVVEVQPLGIAPTGAKERVVEREKE

SEQ ID NO: 499 - protein, 9 aa, Artificial Sequence
  Description of Artificial Sequence: Synthetic peptide
  MOD_RES (9)..(9): Any amino acid
EFGHRVPDX

SEQ ID NO: 500 - protein, 489 aa, Artificial Sequence
  Description of Artificial Sequence: Synthetic polypeptide
MRVTGIRKNCPQWWIWGILGFWMLMNCNGVPVWKEAKTTLFCASDAKAYVKEVHNVWATHACVPTDPSPQELFLKNVTENFNMWKNDMVDQMHEDIISLWDQSLKPCVKLTPLCVTLICSTATVNNSKFEEMKNCSFNTTTEIRDKEKKEYALFYRPDIVPLDNETSNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIKYNQSAGGDMEITTHSFNCGGEFFYCNTSNLFNSTYNDTYISTNSTNSTSYITLQCRIKQIINMWQGVGRAMYAPPIAGNITCKSNITGLLLTRDGGINKDSNETETFRPAGGDMRDNWRSELYKYKVVEVQPLGIAPTGAKERVVEREKE

SEQ ID NO: 501 - protein, 9 aa, Artificial Sequence
  Description of Artificial Sequence: Synthetic peptide
  MOD_RES (9)..(9): Any amino acid
EFGHQDPDX

SEQ ID NO: 502 - protein, 514 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSKVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGINNVSNETETFRPAGGDMRDNWRSELYKYKVVEVQPLGLAPTGAKERVVEREKE

SEQ ID NO: 503 - protein, 9 aa, Artificial Sequence
  Description of Artificial Sequence: Synthetic peptide
  MOD_RES (9)..(9): Any amino acid
EFGHQVPDX

SEQ ID NO: 504 - protein, 489 aa, Artificial Sequence; identical to SEQ ID NO: 472
  Description of Artificial Sequence: Synthetic polypeptide

SEQ ID NO: 505 - protein, 9 aa, Artificial Sequence
  Description of Artificial Sequence: Synthetic peptide
EDPNSVTGS

SEQ ID NO: 506 - protein, 501 aa, Artificial Sequence
  Description of Artificial Sequence: Synthetic polypeptide
MRVTGILRNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKERVVEREKE

SEQ ID NO: 507 - protein, 9 aa, Artificial Sequence
  Description of Artificial Sequence: Synthetic peptide
  MOD_RES (9)..(9): Any amino acid
EFGHRVLDX

SEQ ID NO: 508 - protein, 489 aa, Artificial Sequence
  Description of Artificial Sequence: Synthetic polypeptide
MRVTGILKNYPQWWIWGILGFWMLMNCNGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGNELQKHFPNKTIKYEQAAGGDMEITTHSFNCGGEFFYCNTANLFNGTYNGTDISTNSSANSTSTITLQCKIKQIINMWQGVGRAMYAPPIAGNITCRSNITGLLLTRDGGINNVSNETETFRPAGGDMRDNWRSELYKYKVVEVQPLGIAPTGAKERVVEREKE

SEQ ID NO: 509 - protein, 10 aa, Artificial Sequence
  Description of Artificial Sequence: Synthetic peptide
  MOD_RES (9)..(10): Any amino acid
EFGNRVPDXX

SEQ ID NO: 510 - protein, 499 aa, Artificial Sequence
  Description of Artificial Sequence: Synthetic polypeptide
MRVTGILKNYPRWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTAKLFNSTYNDTYKSTNSSANNSSIITLQCRIKQIINMWQGVGRAMYAPPIAGNITCKSNITGLLLTRDGGINNVSNETETFRPAGGDNWRSELYKYKVVEVQPLGIAPTGAKERVVEREKE

SEQ ID NO: 511 - protein, 9 aa, Artificial Sequence
  Description of Artificial Sequence: Synthetic peptide
  MOD_RES (9)..(9): Any amino acid
EFGNQDPDX

SEQ ID NO: 512 - protein, 508 aa, Artificial Sequence
  Description of Artificial Sequence: Synthetic polypeptide
MRVTGILKNYPRWWIWGILGFWMLMNCNGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNSTTDYDSRSNDTVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSNVSTVQCTHGIRPVVSTQLLLNGSLAKEEIVIRSENLTNNAKTIIVHLHTPVEIVCTRPGNNTRKSMRIGPGQTFYATGDIIGDIRQAHCNISEEKWNKTLQEVGKELQKHFPNRTIKYNQSAGGDMEITTHSFNCGGEFFYCNTSKLFNSTYNDTYISTNSTNSSANNSSIITLQCRIKQIINMWQGVGRAMYAPPIAGNIICKSNITGLLLTRDGGPDSNKTETFRPAGGDMRDNWRSELYKYKVVEVQPLGIAPTGAKERVVEREKE

SEQ ID NO: 513 - protein, 9 aa, Artificial Sequence
  Description of Artificial Sequence: Synthetic peptide
  MOD_RES (9)..(9): Any amino acid
EFGNQVPDX

SEQ ID NO: 514 - protein, 506 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPNPQEMFLKNVTENFNMWKNDMVDQMHEDIISLWDQSLKPCVKLTPLCVTLNCSNATVNSTTDYDSRSNDSVTNITNTIKEEVKNCSFKTTTEIRDKEKKEHALFYRPDIVPLNSETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVQLNTSVEIVCTRPGNNTRKSVRIGPGQTFYATGDIIGDIRQAHCNISEKKWNETLQRVGIELQKHFPNKTIKYNQSAGGDMEITTHSFNCGGEFFYCNTAKLFNSTYNGTYINTTSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKE

SEQ ID NO: 515 - protein, 9 aa, Artificial Sequence
  Description of Artificial Sequence: Synthetic peptide
  MOD_RES (9)..(9): Any amino acid
EFGNRDLDX

SEQ ID NO: 516 - protein, 489 aa, Artificial Sequence
  Description of Artificial Sequence: Synthetic polypeptide
MRVTGILKNYPQWWIWGILGFWMLMNCNGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVSLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHAPVEIVCTRPGHNTRKSVRIGPGQTFYATGDIIGNIRQAHCNINESEWNETLQKVGKELRKHFPNKTIKYEQSAGGDMEITTHSFNCGGEFFYCNTANLFNGTYNGTDISTNSSADRNSTITLECKIKQIINMWQGVGRAMYAPPIAGNITCRSNITGLLLTRDGGINNVSNATETFRPAGGDMRDNWRSELYKYKVVEVQPLGIAPTGAKERVVEREKE

SEQ ID NO: 517 - protein, 9 aa, Artificial Sequence
  Description of Artificial Sequence: Synthetic peptide
  MOD_RES (9)..(9): Any amino acid
EFGNRVLDX

SEQ ID NO: 518 - protein, 496 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKE

SEQ ID NO: 519 - protein, 10 aa, Artificial Sequence
  Description of Artificial Sequence: Synthetic peptide
  MOD_RES (9)..(10): Any amino acid
EFGYRVPDXX

SEQ ID NO: 520 - protein, 502 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHAPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSIITLQCKIKQIINMWQGVGRAMYAPPIAGNITCKSNITGLLLTRDGGINNVSNETETFRPAGGDMRDNWRSELYKYKVVEVQPLGIAPTGAKERVVEREKE

SEQ ID NO: 521 - protein, 9 aa, Artificial Sequence
  Description of Artificial Sequence: Synthetic peptide
  MOD_RES (9)..(9): Any amino acid
EFGYQDPDX

SEQ ID NO: 522 - protein, 504 aa, Artificial Sequence
  Description of Artificial Sequence: Synthetic polypeptide
MRVMGILKNYPRWWIWGILGFWMLMICNGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKERVVEREKE

SEQ ID NO: 523 - protein, 9 aa, Artificial Sequence
  Description of Artificial Sequence: Synthetic peptide
  MOD_RES (9)..(9): Any amino acid
EFGYQVPDX

SEQ ID NO: 524 - protein, 502 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEISNATVKNITIKEMKNCSFNTTTEIRDKIKKERALFYRTDIVPLNKETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRQAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGINNVSNETETFRPAGGDMRDNWRSELYKYKVVEVQPLGIAPTGAKERVVERGKE

SEQ ID NO: 525 - protein, 9 aa, Artificial Sequence
  Description of Artificial Sequence: Synthetic peptide
  MOD_RES (9)..(9): Any amino acid
EFGYRDLDX

SEQ ID NO: 526 - protein, 503 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKTIIVHLHAPVEIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKE

SEQ ID NO: 527 - protein, 9 aa, Artificial Sequence
  Description of Artificial Sequence: Synthetic peptide
  MOD_RES (9)..(9): Any amino acid
EFGYRVLDX

SEQ ID NO: 528 - protein, 504 aa, Artificial Sequence
  Description of Artificial Sequence: Synthetic polypeptide
MRVMGILKNYPRWWIWGILGFWMLMICNGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTTKLFNSTYNGTYISTNSINSTLNITLQCRIKQIINMWQGIGRAMYAPPIAGNITCRSNITGLLLTRDGGIHNDSNETETFRPAGGDMRDNWRSELYKYKVVEIQPLGIAPTGAKERVVERGKE

SEQ ID NO: 529 - protein, 9 aa, Artificial Sequence
  Description of Artificial Sequence: Synthetic peptide
  MOD_RES (9)..(9): Any amino acid
GDRDPNSDX

SEQ ID NO: 530 - protein, 493 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNNETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRKAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGPESNETETFRPAGGDMRDNWRSELYKYKVVEVQPLGIAPTGAKERVVEREKE

SEQ ID NO: 531 - protein, 10 aa, Artificial Sequence
  Description of Artificial Sequence: Synthetic peptide
  MOD_RES (9)..(10): Any amino acid
GHRDPNSDXX

SEQ ID NO: 532 - protein, 496 aa, Artificial Sequence
  Description of Artificial Sequence: Synthetic polypeptide
MRVTGILKNCPLWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVGNSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKE

SEQ ID NO: 533 - protein, 10 aa, Artificial Sequence
  Description of Artificial Sequence: Synthetic peptide
  MOD_RES (9)..(10): Any amino acid
GNRDPNSDXX

SEQ ID NO: 534 - protein, 504 aa, Artificial Sequence
  Description of Artificial Sequence: Synthetic polypeptide
MRVTGILKNCPLWWIWGILGFWMLMNCNGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVRNSTTEKMSDALDRNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEEIVIRSENLTNNAKIIIVQLNANASVEIVCTRPNNNTRKSVRIGPGQTFYATGDIIGDIRQAHCNISEKKWNETLQQVGIELQKHFPNKTIKYNQSAGGDMEITTHSFNCGGEFFYCNTAKLFNSTYNGTYISTDSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVGREKE

SEQ ID NO: 535 - protein, 9 aa, Artificial Sequence
  Description of Artificial Sequence: Synthetic peptide
  MOD_RES (9)..(9): Any amino acid
GYRDPNSDX

SEQ ID NO: 536 - protein, 498 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLENVTENFNMWKNDMVDQMHEDIISLWDQSLKPCVKLTPLCVTLNCSNVNVTRSNVNVTNITNTIKGEMKNCSFNTTTEIRDKEKKEYALFYRSDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLHEVSKELQKHFPNKTIKYAQSAGGDMEITTHSFNCGGEFFYCNTSNLFNGTYNGTYISTNSSANSNSTITLQCRIKQIINMWQGVGRAMYAPPIAGNITCRSNITGLLLTRDGGTKNNKTEETFRPAGGDMRDNWRSELYKYKVVEIQPLGIAPTGAKERVVEREKE

SEQ ID NO: 537 - protein, 486 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELVLGNVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKE

SEQ ID NO: 538 - protein, 505 aa, Artificial Sequence
  Description of Artificial Sequence: Synthetic polypeptide
MRVMGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTDYDTRSNVNVTNITNTIKGEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKE

SEQ ID NO: 539 - protein, 507 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKERVVEREKE

SEQ ID NO: 540 - protein, 489 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVDNRTVGEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGEIRQAHCNISEEKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKE

SEQ ID NO: 541 - protein, 489 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKE

SEQ ID NO: 542 - protein, 490 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLDNVTENFNMWKNDMVDQMHEDIISLWDQSLKPCVKLTPLCVTLICSNATVKNRTVYEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYEQSAGGDMEITTHSFNCGGEFFYCNTSNLFNGTYNGTDISTNSSAKSNSTITLQCRIKQIINMWQGVGRAMYAPPIAGNITCKSNITGLLLTRDGGNSSKTEEETFRPAGGDMRDNWRSELYKYKVVEIQPLGIAPTGAKERVVEREKE

SEQ ID NO: 543 - protein, 491 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKERVVEREKE

SEQ ID NO: 544 - protein, 486 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNAPVEIVCTRPNNDTRKSVRIGPGQTFYATGDIIGDIRQAHCNISEKEWNETLQKVGIELQKHFPNKTIKYEQSAGGDMEITTHSFNCGGEFFYCNTSKLFNGTYNGTYINTSSNSTITLQCRIKQIINMWQGVGRAMYAPPIAGNITCKSDITGLLLTRDGGTNSSGKEEIFRPAGGDMRDNWRSELYKYKVVEIQPLGIAPTGAKERVVEREKE

SEQ ID NO: 545 - protein, 489 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNSSKTEEETFRPAGGDMRDNWRSELYKYKVVEIQPLGIAPTGAKERVVEREKE

SEQ ID NO: 546 - protein, 489 aa, Artificial Sequence
  Description of Artificial Sequence: Synthetic polypeptide
MRVMGILKNYPQWWIWGILGFWMLMICNGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEEEWNDTLQKVGKELQKHFPNKTIEYKQSAGGDMEITTHSFNCGGEFFYCNTAKLFNGTYNGTDISTNSSTNSNPTITLQCRIKQIINMWQGVGRAMYAPPIAGNITCKSNITGLLLTRDGGNSSKTEEEIFRPAGGDMRDNWRSELYKYKVVEIQPLGIAPTGAKERVVEREKE

SEQ ID NO: 547 - protein, 487 aa, Artificial Sequence
  Description of Artificial Sequence: Synthetic polypeptide
MRVMGILKNYPQWWIWGILGFWMLMNCNGVPVWKEAKTTLFCASDAKAYKKEVHNVWATHACVPTDPSPQELFLDNVTENFNMWKNDMVDQMHEDIISLWDQSLKPCVKLTPLCVTLICSNATVENKTVEEMKNCSFNTTTEIRDKEKKEYALFYKPDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKE

SEQ ID NO: 548 - protein, 487 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKE

SEQ ID NO: 549 - protein, 488 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSGKEEIFRPAGGDMRDNWRSELYKYKVVEIQPLGIAPTGAKERVVEREKE

SEQ ID NO: 550 - protein, 488 aa, Artificial Sequence
  Description of Artificial Sequence: Synthetic polypeptide
MRVMGILKNYPQWWIWGILGFWMLMICNGVPVWKEAKTTLFCASDARAYEKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKERVVEREKE

SEQ ID NO: 551 - protein, 488 aa, Artificial Sequence
  Description of Artificial Sequence: Synthetic polypeptide
MRVMGIPKNYPQWWIWGILGFWMLMICNGVPVWKEAKTTLFCASDAKAYKKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKERVVEREKE

SEQ ID NO: 552 - protein, 488 aa, Artificial Sequence
  Description of Artificial Sequence: Synthetic polypeptide
MRVMGILKNYPQWWIWGILGFWMLMICNGVPVWKEAKTTLFCASDAKAYKKEVHNVWATHACVPTDPSPQELFLKNVTENLNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIRQAHCNISEKQWNDTLQKVGKELQKHFPNKTIKYKHSAGGDMEITTHSFNCGGEFFYCNTSNLFNGTYNGTYMNISTDSNSTITLQCRIKQIINMWQGVGRAMYAPPIAGNITCKSHITGLLLTRDGGTNSSGKEEIFRPAGGDMRDNWRSELYKYKVVEIQPLGIAPTGAKERVVEREKE

SEQ ID NO: 553 - protein, 489 aa, Artificial Sequence
  Description of Artificial Sequence: Synthetic polypeptide
MRVMGIPKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSTATVNKSTVEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEEEIVIRSENLTNNAKIIIVHLHTPVEIVCTRPNNNTRKSVRIGPGQTFYATGGIIGDVRQAHCNISKGLWNDTLQKVGKELQKHFPNKTIRYNQSAGGDMEITTHSFNCGGEFFYCNTAKLFNGTYNGTDISTNSSANNSSTITLQCRIKQIINMWQGVGRAMYAPPIAGNITCKSNITGLLLTRDGGINSSREEEIFRPAGGDMRDNWRSELYKYKVVEVQPLGIAPTGAKERVVEREKE

SEQ ID NO: 554 - protein, 489 aa, Artificial Sequence
  Description of Artificial Sequence: Synthetic polypeptide
MRVMGIPKNYPRWWIWGILGFWMLMICNGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKE

SEQ ID NO: 555 - protein, 489 aa, Artificial Sequence
  Description of Artificial Sequence: Synthetic polypeptide
MRVMGIPKNYPRWWIWGILGFWMLMICNGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKERVVEREKE

SEQ ID NO: 556 - protein, 489 aa, Artificial Sequence
  Description of Artificial Sequence: Synthetic polypeptide
MRVMGIPKNYPRWWIWGILGFWMLMICNGVPVWKEAKTTLFCASDAKAYVKEVHNIWATHACVPTDPSPQELLLKNVTENFNMWKNDMVDQMHEDIISLWDQSLKPCVKLTPLCVTLICSNATVNQSTTEEMKNCSFNTTTEIRDKEKKEHALFYRPDIVPLDNETGNTSEYRLINCNTSAVTQACPKVTFEPIPIHYCAPAGYAILKCNDETFNGTGPCSKVSTVQCTHGIRPVVSTQLLLNGSLAEKGIVVRSENLTNNAKIIIVQLNASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKE

SEQ ID NO: 557 - protein, 504 aa, Artificial Sequence
  Description of Artificial Sequence: Synthetic polypeptide
MRVMGIPKNYPLWWIWGILGFWMLMNCNGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVERGKE

SEQ ID NO: 558 - protein, 501 aa, Artificial Sequence
  Description of Artificial Sequence: Synthetic polypeptide
MRVMGILKNYPQWWIWGILGFWMLMNCNGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHTPVEIVCTRPYNNTRKSVRIGPGQTFYATGDIIGDPRQAHCNISKETWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGTTNNSNETETFRPAGGDMRDNWRSELYKYKVVEVQPLGLAPTGAKERVVEREKE

SEQ ID NO: 559 - DNA, 2089 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgcactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgagggatcc

SEQ ID NO: 560 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcgaacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtgaccgaattcgggacccggatcc

SEQ ID NO: 561 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcgggacccggatcc

SEQ ID NO: 562 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtaaccgaattcgggacccggatcc

SEQ ID NO: 563 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtccaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcgccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggttaccgaattcgggacccggatcc

SEQ ID NO: 564 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtgaccgaattcgggtcccggatcc

SEQ ID NO: 565 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcggcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaagtgcagcaacgccatcgtggactccagcaaggtgtacgacacgaggtccaaggtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacctcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctgggacaccaactggtccaacaagtcggagaaggacatctgggacaacatgacctggatgcagtgggagcgcgagatctccaactacaccgagaccatctacaagctcctcgaggactcccagcaccagcaggagcggaacgagcaggatctgctcgcgctggactcgtggaactccctgtggaactggttcaacatcaccaactggctgtggtacatcaagtagtgaggtgaccgaattcaggacccggatcc

SEQ ID NO: 566 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtgaccgaattcaggtcccggatcc

SEQ ID NO: 567 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggccacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtgaccgaattcgggacctggatcc

SEQ ID NO: 568 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcgcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcaccaactccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtgaccgaattcgggtcctggatcc

SEQ ID NO: 569 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcgggtcccggatcc

SEQ ID NO: 570 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcaggacccggatcc

SEQ ID NO: 571 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaacagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcaggtcccggatcc

SEQ ID NO: 572 - DNA, 2120 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtccgacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactcctcgaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacgcctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcgggacctggatcc

SEQ ID NO: 573 - DNA, 2108 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcagcacgaactccaccagctcgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgacgtgccctggaacacctcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatccggtagtgaggtcaccgaattcgggtcctggatcc

SEQ ID NO: 574 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtcccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacaactcctggtccaacaagtcggagaaggacatctgggacaacatgacctggatgcagtgggagcgcgagatctccaactacaccgagaccatctacatgctcctcgaggactcccagcaccagcaggagcggaacgagaaggatctgctcgcgctggactcgtggaactccctgtggaactggttcaacatcaccaactggctgtggtacatcaagtagtgaggtaaccgaattcgggtcccggatcc

SEQ ID NO: 575 - DNA, 2108 bp, Artificial Sequence
  Description of Artificial Sequence: Synthetic polynucleotide
ggtcgacaagaagccaccatgcgcgtgatgggcatcccgaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccatcgtggactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggcccgcgagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccatctgggggatcaagcagctgcaggccagggtgctcgcgctcgagcgctacctgaaggaccagcagctgctcggcatgtggggctgctccggcaagctgatctgcaccaccgcggtgccctggaacacgtcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatccggtagtgaggtaaccgaattcaggacccggatcc

SEQ ID NO: 576 - DNA, 2108 bp, Artificial Sequence
  Description of Artificial Sequence: Synthetic polynucleotide
ggtcgacaagaagccaccatgcgcgtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagtggcagtggaacaagaccctgcacgaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaactcgtcctggtccaacaagtcggagaaggacatctgggacaacatgacctggatgcagtgggagcgcgagatctccaactacaccgagaccatctacaagctcctcgaggactcccagcaccagcaggagcggaacgagcaggatctgctcgcgctggactcgtggaactccctgtggaactggttcaacatcaccaactggctgtggtacatcaagtagtgaggtaaccgaattcaggtcccggatcc

SEQ ID NO: 577 - DNA, 2108 bp, Artificial Sequence
  Description of Artificial Sequence: Synthetic polynucleotide
ggtcgacaagaagccaccatgcgcgtgatgggcatccccaagaactacccgcagtggtggatctggggcatcctgggcttctggatactcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcaacagcgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctacaagccggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagggccagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcgtccacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatcaagtagtgaggtaaccgaattcgggacctggatcc

SEQ ID NO: 578 - DNA, 2120 bp, Artificial Sequence
  Description of Artificial Sequence: Synthetic polynucleotide
ggtcgacaagaagccaccatgcgcgtgcggggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaccgtgaactccagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagcgccagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgacgaactcctccaccaactcgacgagcaacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacgcgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatccggtagtgaggtaaccgaattcgggtcctggatcc

SEQ ID NO: 579 - DNA, 2108 bp, Artificial Sequence
  Description of Artificial Sequence: Synthetic polynucleotide
ggtcgacaagaagccaccatgcgcgtgatgggcatcctcaagaactacctgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggagaacgtgatcgagaacttcaacatgtggaagaacgacatggtggaccagatgcacgaggacatcatctccctgtgggaccagtccctgaagccctgcgtgaagctgaccccgctgtgcgtgaccctgacctgcagcaacgccaccgtggacaacagcaaggtgtacgacacgaggtccaacgtgaacgtcacgagcatcaacaacacgatcatgggcgagatgaagaactgctccttcaacacgacgacggagatccgcgacaaggagaagaaggagtacgccctgttctaccggtcggacgtcgtgccgctggacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtccgtggagatcgtgtgcacccgcccgggcaacaacacgcgcaagtccgtccggatcggccctggccagaccttctacgccaccggcgacatcatcggcgacatccgccaggcccactgcaacatcagcgagcggcagtggtacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgatcaactccacgagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccctggaacacctcctggtccaacaagtcggagaaggacatctgggacaacatgacctggatgcagtgggagcgcgagatctccaactacaccgagaccatctacacgctcctcgaggactcccagcaccagcaggagcggaacgagaaggatctgctcgcgctggactcgtggaactccctgtggaactggttcaacatcaccaactggctgtggtacatcaagtagtgaggttaccgaattcgggtcccggatcc

SEQ ID NO: 580 - DNA, 2078 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtggcctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgaggttaccgaattcaggacccggatcc

SEQ ID NO: 581 - DNA, 2072 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggggcagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatcaacacgtcctccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgaggttaccgaattcaggtcccggatcc

SEQ ID NO: 582 - DNA, 2078 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtggcctggaacacctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgaggttaccgaattcgggacctggatcc

SEQ ID NO: 583 - DNA, 2072 bp, Artificial Sequence
  Description of Artificial Sequence: Synthetic polynucleotide
ggtcgacaagaagccaccatgcgggtgatgggcatcctcaagaactacccgcgctggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgccaggtccaacgtgaacgtcacgagcatcaacaacacgatcatgggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcaccgacatctccaccaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccacggtgccctggaacgcctcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagtagtgaggttaccgaattcgggtcctggatcc

SEQ ID NO: 584 - DNA, 2069 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtcgaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcacctacatctccaccaactccaccagctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaacaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgccgtggcgtggaacacctcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagtagtgagggacccgaattcggtgaccggatcc

SEQ ID NO: 585 - DNA, 2075 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcagcaacgtcaacgtggtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcaggaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcccgtacatcaacatctccaccaactccaacagcaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgccgtggcgtggaacacctcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagtagtgagggacccgaattcggtcaccggatcc

SEQ ID NO: 586 - DNA, 2075 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctggactgctcgaacgtgaacgtcgtgaacgtcacgaacatcaccaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggccgagaaggagatcgtcatccggtccgagaacctcacgaacaacgcgaagatcatcatcgtgcacctgaacacgccggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacatcaacatctccaccaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaccaccgcggtgccgtggaactcctcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaagtggctgtggtacatcaagtagtgagggacccgaattcggtaaccggatcc

SEQ ID NO: 587 - DNA, 2066 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgtccaacgtgaacgtcacgaacatcacgaacacgatcaagggcgagatgaagaactgctccttcaacacgacgacggagatccgcgacaaggagaagaaggagtacgccctgttctaccggcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctactccaccaactccaccagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcaacaccgcggtggcctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagggacccgaattcggttaccggatcc

SEQ ID NO: 588 - DNA, 2081 bp, Artificial Sequence
  Description of Artificial Sequence: Synthetic polynucleotide
ggtcgacaagaagccaccatgcgggtgatgggcatcctcaagaactacccgccgtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtgaacgtggtgaacgtcacgaacatcacgaacacgatcaagggcgagatgaagaactgctccttcaacacgacgacggagatccgcgacaaggagaagaaggagtacgccctgttctacaagcccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtccaaggagctgcagaagcacttccccaacaagacgattaagtacgagcggtcggccggcggcgacatggagatcgccacgcactccttcaactgcggtggcgagttcttctactgcaacacgtcgaacctgttcaacggcacctacaacggcacctacatctcgaccaactcgtccgcgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgcggtggcctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagggtcccgaattcggtgaccggatcc

SEQ ID NO: 589 - DNA, 2109 bp, Artificial Sequence
  Description of Artificial Sequence: Synthetic polynucleotide
ggtcgacaagaagccaccatgaaggtgatgggcatcctcaagaactacccgcagtggtggatctggggcatcctgggcttctggatgctcatgatctgcaagggcaagggcaacctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgcctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagcggtcggccggcggcgacatggagatcgccacgcactccttcaactgcggtggcgagttcttctactgcaacacgtcgaagctgttcaacggcacctacaacggcaccgacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagtagtgagaggacccgaattcggtgaccggatcc

SEQ ID NO: 590 - DNA, 2082 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtgaccgggtccaacgtgaacgtcacgaacatcacgaacacgatcaccggcgagatgaagaactgctccttcaacacgacgacggagatccgcgacaaggagaagaaggagtacgccctgttctacaagcccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgggcaacaacacgcgcaagtccgtccggatcggccctggccagaccttctacgccaccggcggcatcatcggcgacatccgccaggcccactgcaacatcagcgagtcgaagtggaacgagaccctgcacgaggtgtccaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagaggtcccgaattcggtgaccggatcc

SEQ ID NO: 591 - DNA, 2081 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtggtgaacgtcacgaacatcacgaacacgatcaagggcgagatgaagaactgctccttcaacacgacgacggagatccgcgacaaggagaagaaggagtacgccctgttctaccgccccgacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcaagtacatcaacatctccacgaactccaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaccaagaacaactcgacggagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagggacctgaattcggtgaccggatcc

SEQ ID NO: 592 - DNA, 2108 bp, Artificial Sequence
  Description of Artificial Sequence: Synthetic polynucleotide
ggtcgacaagaagccaccatgcgggtgatgggcatcctcaagaactgcccgcagtggtggatctggggcatcctgggcttctggatgctcatgatctgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctcgaacgtgtccgtcacgtccatcaacaacacgatcatgggcgagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgtccaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaccaacatctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagggtcctgaattcggtgaccggatcc

SEQ ID NO: 593 - DNA, 2057 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgcgtgaacgtcacgaacatcacgaacacgatcaagggcgagatgaagaactgctccttcaacacgacgacggagatccgcgacaaggagaagaaggagtacgccctgttctaccgccccgacgtcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccggggaacaacacgcgcaagtccgtccggatcggccctggccagaccttctacgccaccggcgacatcatcggcgacatccgccaggcccactgcaacatcagcgaggagaagtggaacaagaccctgcagcaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacgtacaacggctccacgaactccaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacacgctcctcgaggactcccagcgccagcaggagcggaacgagaaggatctgctcgcgctggactcgtggaactccctgtggaactggttcaacatcaccaactggctgtggtacatcaagtagtgagggtcccgaattcggtcaccggatcc

SEQ ID NO: 594 - DNA, 2103 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgcgaacgtcacgtccatcaacaacacgatcatgggcgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaacctgttcaacggcacctacaacggcacctacaacgggaccaactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactccaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccacggtggcgtggaacacgtcctggtccaacaagtcggagaaggacatctgggacaacatgacctggatgcagtgggagcgcgagatctccaactacaccgagaccatctacaccctcctcgaggactcccagcgccagcaggagcggaacgagaaggatctgctcgcgctggactcgtggaactccctgtggaactggttcaacatcaccaactggctgtggtacatcaagtagtgagaggacccgaattcggtcaccggatcc

SEQ ID NO: 595 - DNA, 2103 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgatctgctcgggccgcgggaacctctgggtgacggtgtactacggcgtgccggtgtggaaggaggccaagacgaccctgttctgcgcgtcggacgccaaggcctacgagaaggagatgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgacacgcgctccaacgtgaacgtcacgtccatcaacaacacgatcatgggcgagatgaagaactgctccttcaacacgacgacggagatccgcgacaaggagaagaaggagtacgccctgttctacaagcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcggtcggccggcggcgacatggagatcaccacgcactccttcaactgcggtggcgagttcttctactgcaacacgtcgaagctgttcaacggcacctacaacgggatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaaccggaacaacagcaacgaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagtagtgagaggtcccgaattcggtcaccggatcc

SEQ ID NO: 596 - DNA, 2054 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgggcgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgtcgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagggacctgaattcggtcaccggatcc

SEQ ID NO: 597 - DNA, 2054 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggggaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccatgggcgagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtgatccggtccgagaacctcacgaacaacgcgaagatcatcatcgtgcacctgaacacgcccgtggagatcgtgtgcacccgcccgggcaacaacacgcgcaagtccgtccggatcggccctggccagaccttctacgccaccggcgcgatcatcggcgacatccgccaggcccactgcaacatcagcgagtccaagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagtagtgagggtcctgaattcggtcaccggatcc

SEQ ID NO: 598 - DNA, 2057 bp, Artificial Sequence
  Description of Artificial Sequence: Synthetic polynucleotide
ggtcgacaagaagccaccatgaaggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgagaagcagtggaacgagaccctgcagaaggtgggcaaggagctgcagaagcacttccccaacaagacgattaagtacgagaggtcggccggcggcgacatggagatcaccacgcactccttcaactgcggtggcgagttcttctactgcaacacgtcgaagctgttcaacggcacgtacaacgggaccgacatctccacgaactcgtccgcgaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgcggtggcctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagggtcccgaattcggtaaccggatcc

SEQ ID NO: 599 - DNA, 2055 bp, Artificial Sequence
  Description of Artificial Sequence: Synthetic polynucleotide
ggtcgacaagaagccaccatgcgggtgatgggcatcctcaagaactgcccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccggcccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacaagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcccagtcggccggcggcgacatggagatcaccacgcactccttcaactgcggtggcgagttcttctactgcaacacgtcgaagctgttcaacgggacgtacaacggcgcctacatcaacatctcgaccaactcgaacagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaagacggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagtagtgagaggacccgaattcggtaaccggatcc

SEQ ID NO: 600 - DNA, 2058 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtcctgaagaacgtgaccgagaacttcaacatgtggaagaacaaccgggtggaccagatgcacgaggacatcatctccctgtgggaccagtccctgaagccctgcgtgaagctgaccccgctgtgcgtgaccctgatctgctcgaacgccacggtggacaaccgcaccgtcggggagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaaccggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcggcatcatcggcgacatccgccaggcccactgcaacatcagcgaggggcagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacggcacgtacaacggcacctacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagaggtcccgaattcggtaaccggatcc

SEQ ID NO: 601 - DNA, 2108 bp, Artificial Sequence
  Description of Artificial Sequence: Synthetic polynucleotide
ggtcgacaagaagccaccatgcgggtgacgggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcagaaggtgggcaaggagctgcagaagcacttccccaacaagacgattaagtacgagcgccccgccggcggcgacctggagatcaccacgcactccttcaactgcggtggcgagttcttctactgcaacacgtcgaagctgttcaacggcacgtacaacggcaccgacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagaaggatctgctcgcgctggactcgtggaactccctgtggaactggttcaacatcaccaagtggctgtggtacatcaagtagtgagggacctgaattcggtaaccggatcc

SEQ ID NO: 602 - DNA, 2120 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcaaggggaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcaaggagctgcagaagcacttccccaacaagacgattaagtacgcgcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaccagcaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgccgtgccctgggactcgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaactggctgtggtacatcaagtagtgagggtcctgaattcggtaaccggatcc

SEQ ID NO: 603 - DNA, 2063 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaagggcaaggggaacctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgagatgaagaactgctccttcaacacgacgacggagatccgcgacaaggagaagaaggagtacgccctgttctaccgctcggacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgagatccgccaggcccactgcaacatcagcgagtcgaagtggaacgagaccctgcagaaggtgggcaaggagctgcagaagcacttccccaacaagacgattaagtacgagcgctcggccggcggcgacatggagatcaccacgcactccttcaactgcggtggcgagttcttctactgcaacacgtcgaagctgttcaacggcacgtacaacggcaccgacatctccacgaactcgtccgccaactcgaacagcacgatcacgctccagtgccgcatcaagcagatcatcaacatctggcagggggtgggccgcgctatgtacgcaccgcccatcgccggcaacatcacctgcaagtccaacatcaccggcctcctgctgacccgcgacggcggcaacaacaacaaccggaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcggcagcaggagcggaacgagaaggatctgctcgcgctggactcgtggaactccctgtggaactggttcaacatcaccaactggctgtggtacatcaagtagtgagggtcccgaattcggttaccggatcc

SEQ ID NO: 604 - DNA, 2067 bp, Artificial Sequence
  Description of Artificial Sequence: Synthetic polynucleotide
ggtcgacaagaagccaccatgcgggtgatgggcatccccaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggacaaccgcaccgtcggcgagatgaagaactgctccttcaacacgacgacggagatccgcgacaaggagaagaaggagtacgccctgttctaccgcccggacatcgtgccgctgtccgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgagatcaagcaggcccactgcaacatcagcgaggagaagtggaacgagaccctgcagaaggtgggcaaggagctgcagaagcacttccccaacaagatcattaagtacgcccagtcggccggcggcgacatggagatcaccacgcactccttcaactgcggtggcgagttcttctactgcaacacggcgaacctgttcaacggcacgtacaacggcaccgacatctccacgaactcgtccaccaagtcgaacagcacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcgaagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagaggacccgaattcggttaccggatcc

SEQ ID NO: 605 - DNA, 2064 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgatctgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacgtccaacctgttcaacggcacgtacaacggcacctacatgaacatctccaccgactcgaacagcacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaactcgagcaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagaggtcccgaattcggttaccggatcc

SEQ ID NO: 606 - DNA, 2066 bp, Artificial Sequence
  Description of Artificial Sequence: Synthetic polynucleotide
ggtcgacaagaagccaccatgcgggtgatgggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagtccaagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaccacgtccaagctgttcaacgggacgtacaacggcacggacatctccacgaactcctcggcgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcgggaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagggacctgaattcggttaccggatcc

SEQ ID NO: 607 - DNA, 2072 bp, Artificial Sequence
  Description of Artificial Sequence: Synthetic polynucleotide
ggtcgacaagaagccaccatgcgcgtgaccggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggccaacctgttcaacgggacgtacaacggcacggacatctccacgaactcctcgacgaagtcgaactcgacgatcacgctccagtgccgcatcaagcagatcatcaacatgtggcagggggtgggccgcgctatgtacgcaccgcccatcgccggcaacatcacctgccggtccaccatcaccggcctcctgctgacccgcgacggcggcaacaactcgagcaagacggaggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcgaagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagggtcctgaattcggttaccggatcc

SEQ ID NO: 608 - DNA, 2066 bp, Artificial Sequence
  Description of Artificial Sequence: Synthetic polynucleotide
ggtcgacaagaagccaccatgcgcgtgatgggcatccccaagaactgcccgcagtggtggatctggggcatcctgggcttctggatgctcatgatctgcaacggcaaggggaagctctgggtgacgatctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacggccaagctgttcaacgggacgtacaacggcacggacatctccacgaactcctcggcggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcaccaactcgagcgaggaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtgagaattcggtgaccgggacccggatcc

SEQ ID NO: 609 - DNA, 2063 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgaactgcaacggcaaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacacgcggcaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtgagaattcggtcaccgggacccggatcc

SEQ ID NO: 610 - DNA, 2060 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgaactgcaacggcaaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgcacgccacggtggagaactccacgaccgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcggcatcatcggcgagatccggcaggcccactgcaacatcagcaaggagacctggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggccaagctgttcaactcgacgtacaacggcacctacatctccacgaactccacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgtcggaggaggagatcttcaggccagcgggaggcgacatgcgcgacaactggcgctccgagctgtacaagtacaaggtggtggaggtgcagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtgagaattcggtaaccgggacccggatcc

SEQ ID NO: 611 - DNA, 2066 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgatctgcaacggcgaggagaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatgtgctcgaacgccatcgtgaagaactccacgaccgaggagatgaagaactgctccttcaacacgacgacggagatccgcgacaaggagaagaaggagtacgccctgttctaccgcccggacatcgtgccgctgaacaacaagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtgcagatcgtgtgcacccgcccgaacaacaacacgcgcaagtccgtccggatcggccctggccagaccttctacgccaccggcgacatcatcggcgacccgcggcaggcccactgcaacatcagcgagaagaagtggaacgagaccctgcagaaggtgggcatcgagctgcagaagcacttccccaacaagaccatcaagtacaaccagtcggccggcggcgacatggagatcaccacgcactccttcaactgcggtggcgagttcttctactgcaacacggccaagctgttcaactcgacgtacaacggcacctacatctccacgaactccacggactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtgagaattcggttaccgggacccggatcc

SEQ ID NO: 612 - DNA, 2069 bp, Artificial Sequence
  Description of Artificial Sequence: Synthetic polynucleotide
ggtcgacaagaagccaccatgcgcgtgatgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtgaacaagtccacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgggatcgtcggcgacatccggcaggcccactgcaacatcagcaagggcctctggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgagcaacctgttcaacggcacgtacaacggcacctacatctccacgaactcgtccgcgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtgagaattcggtgaccgggtcccggatcc

SEQ ID NO: 613 - DNA, 2066 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtggagaacggcacggtggaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacccgcggcaggcccactgcaacatcagcaaggagaagtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacggcgaagctgttcaacagcacgtacaacggcacctacatctccacgaactcgacgaactcgacctcgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaggatctgctcgcgctggactcgtggaactccctgtggaactggttcaacatcaccaagtggctgtggtacatcaagtagtgagaattcggtgaccaggacccggatcc

SEQ ID NO: 614 - DNA, 2066 bp, Artificial Sequence
  Description of Artificial Sequence: Synthetic polynucleotide
ggtcgacaagaagccaccatgcgcgtgatgggcatccagaagaactacccgcgctggtggatctggggcatcctgggcttctggatgctcatgatctgcaacggcgagggcaagctctgggtgacggtctactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactcgaccacggaggagatgaagaactgctccttcaacacgacgacggagatccgcgacaaggagaagaaggagcacgccctgttctaccgcccggacatcgtgccgctgaacaacgagacgggcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacgtcgaagctgttcaacagcacgtacaacggcacctacatctccacgaactcgacgaactcgacctcgtacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatcaacaacgactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctgggacaacatgacctggatgcagtgggagcgcgagatctccaactacaccgggaccatctacaagctcctcgaggactcccagaaccagcaggagcggaacgagcaggatctgctcgcgctggactcgtggaactccctgtggaactggttcaacatcaccaagtggctgtggtacatcaagtagtgagaattcggtgaccaggtcccggatcc

SEQ ID NO: 615 - DNA, 2063 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgcccgggcctacgagaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgatcgccacggcgaacggctcgacggtggaggagatgaagaactgctccttcaacacgacgacggagatccgcgacaaggagaagaaggagtacgccctgttctaccgcccggacatcgtgccgctgaacaacaagacgtcgaacatctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatcagcaaggagcggtggaacgacaccctgcagaaggtgggcaaggagctgcagaagcacttccccaacaagaccatccgctacaaccagtcggccggcggcgacatggagatcaccacgcactccttcaactgcggtggcgagttcttctactgcaacacgtcgaacctgttcaacagcacgtacaacgacacctacatctccacgaactcgtccgcgaacaactcctcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacggactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaggatctgctcgcgctggactcgtggaacaacctgtggtcgtggttctccatcaccaagtggctgtggtacatcaagtagtgagaattcggtgaccgggacctggatcc

SEQ ID NO: 616 - DNA, 2069 bp, Artificial Sequence
  Description of Artificial Sequence: Synthetic polynucleotide
ggtcgacaagaagccaccatgcgcgtgacgggcatcctcaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcgtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggaggagatgaagaactgctccttcaacacgacgacggagatccgcgacaaggagaagaaggagcacgccctgttctaccgcccggacatcgtgccgctgaacaacgagacgggcaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcaacatccggcaggcccactgcaacatcagcgagtcgaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacggcgaagctgttcaacagcacgtacaacggcacctacatctccacgaactcgacgaactcgacgtccaagaacatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcacgacgaacaactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaggatctgctcgcgctggactcgtggaactcgctgtggtcgtggttcaacatcaccaagtggctgtggtacatcaagtagtgagaattcggtgaccgggtcctggatcc

SEQ ID NO: 617 - DNA, 2066 bp, Artificial Sequence
  Description of Artificial Sequence: Synthetic polynucleotide
ggtcgacaagaagccaccatgcgcgtgacgggcatcctcaagaactacccgcagtggtggatctggggcatcctgggcttctggatgctcatgacgtgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgacggtggacgagatgaagaactgctccttcaacgcgacgacggagatccgcgacaagaagaagaaggagtacgccctgttctaccgctccgacgtcgtgccgctggacgagacgaacaacacgtcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccggggcacaacacgcgcaagtccgtccggatcggccctggccagaccttctacgccaccggcgacatcatcggcgacatccggcaggcccactgcaacatcaacgagtcggagtggaacgagaccctgcagaaggtgggcaaggagctgcagaagcacttccccaacaagaccatcaagtacgagcagtcggccggcggcgacatggagatcaccacgcactccttcaactgcggtggcgagttcttctactgcaacacggcggagctgttcaacggcacgtacaacggcaccgacatctccacgaactcgtcggcgaactccacgtccacgatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcatcaacaacgtctcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcggcagcaggagcggaacgagaaggatctgctcgcgctggactcgtggaactcgctgtggaactggttcaacatcaccaactggctgtggtacatcaagtagtgagaattcggtcaccgggtcccggatcc

SEQ ID NO: 618 - DNA, 2066 bp, Artificial Sequence
  Description of Artificial Sequence: Synthetic polynucleotide
ggtcgacaagaagccaccatgcgcgtgacgggcatccggaagaactgcccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactcgaagttcgaggagatgaagaactgctccttcaacaccacgacggagatccgcgacaaggagaagaaggagtacgccctgttctaccgccccgacatcgtgccgctggacaacgagacgtccaacatctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgaacaacaacacgcgcaagtccgtccggatcggccctggccagaccttctacgccaccggcgacatcatcggcaacccgcggcaggcccactgcaacatctcgaaggagcggtggaacgacaccctgcagaaggtgggcaaggagctgcagaagcacttccccaacaagaccatcaagtacaaccagtcggccggcggcgacatggagatcaccacgcactccttcaactgcggtggcgagttcttctactgcaacacgtccaacctgttcaactcgacgtacaacgacacctacatctccacgaactcgaccaactccacgtcctacatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaaggactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgggaccatctacaagctcctcgaggactcccagaaccagcaggagcggaacgagcaggatctgctcgcgctggactcgtggaactcgctgtggaactggttctccatcaccaagtggctgtggtacatcaagtagtgagaattcggtcaccaggacccggatcc

SEQ ID NO: 619 - DNA, 2141 bp, Artificial Sequence
  Description of Artificial Sequence: Synthetic polynucleotide
ggtcgacaagaagccaccatgcgcgtgacgggcatcctgaagaactgcccgctgtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtgaagaactccaccaccgaggagatgagcaacgccaccgtcaagaacagcaccacggaggagatgtccaacgccacggtgaagaactcgacgacagaggagatgaagaactgctccttcaacaccacgacggagatccgcgacaaggagaagaaggagtacgccctgttctaccgccccgacgtcgtgccgctggacgagacgaacaacacctcgaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtccggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtccaacctgttcaactcgacgtacaacgacacctacatctccccgaactcgaccaactccacgtccaccatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcctcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgggaccatctacaagctcctcgaggactcccagaaccagcaggagcggaacgagcaggatctgctcgcgctggactcgtggaactcgctgtggaactggttctccatcaccaagtggctgtggtacatcaagtagtgagaattcggtcaccaggtcccggatcc

SEQ ID NO: 620 - DNA, 2123 bp, Artificial Sequence
  Description of Artificial Sequence: Synthetic polynucleotide
ggtcgacaagaagccaccatgcgcgtgacgggcatcctgaagaactacccgcgctggtggatctggggcatcctgggcttctggatgctcatgaactgcaacggcgagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtgaacaacaccaccgactacgactccaggagcaacgccaacgtcaccaacatcaccaacaccatcaaggaggaggtgaagaactgctccttcaagaccacgacggagatccgcgacaaggagaagaaggagcacgccctgttctaccgccccgacatcgtgccgctgaactcggagacggggaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgggcaacaacacgcgcaagtccatgcggatcggccctggccagaccttctacgccaccggcgacatcatcggcgacatccggcaggcccactgcaacatctcggagtcgaagtggaacgacaccctgcagaaggtgggcatcgagctgcagaagcacttccccaacaagaccatcaagtacaaccagtcggccggcggcgacatggagatcaccacgcactccttcaactgcggtggcgagttcttctactgcaacacggccaagctgttcaactcgacgtacaacggcacctacatctccacgaactcgtccgccaactccacgtccaagaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggggcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagacggacatctgggagaacatgacctggatgcagtgggagcgcgagatctccaactacaccgagaccatctacaagctcctcgaggactcccagaaccagcaggagcggaacgagcaggatctgctcgcgctggactcgtggaactcgctgtggaactggttctccatcaccaagtggctgtggtacatcaagtagtgagaattcggtcaccgggacctggatcc

SEQ ID NO: 621 - DNA, 2102 bp, Artificial Sequence
  Description of Artificial Sequence: Synthetic polynucleotide
ggtcgacaagaagccaccatgcgcgtgacgggcatcctgcggaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccacggaggagatgtccaccgccctcgtgaagaactccacgaccgaggcgatgaagaactgctccttcaacaccacgacggagatccgcgacaaggagaagaaggagtacgccctgttctaccgccccgacatcgtgccgctgaacaacgagacggggaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcacctgcacacgccggtggagatcgtgtgcacccgcccgaacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtcggccggcggcgacatggagatcaccacgcactccttcaactgcggtggcgagttcttctactgcaacacgtcgaagctgttcaactcgacgtacaacgacacctacatctccacgaactcgtccgccaacaactcgtccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcccggactcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagacggacatctgggggaacatgacctggatgcagtgggagcgcgagatctccaactacaccgagaccatctacaagctcctcgaggactcccagaaccagcaggagcggaacgagcagaacctgctcgcgctggactcgtggaactcgctgtggaactggttctccatcaccaagtggctgtggtacatcaagtagtgagaattcggtcaccgggtcctggatcc

SEQ ID NO: 622 - DNA, 2066 bp, Artificial Sequence
  Description of Artificial Sequence: Synthetic polynucleotide
ggtcgacaagaagccaccatgcgcgtgacgggcatcctgaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgccgctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgggccacaacacgcgcaagtccgtgcggatcggccctggccagaccttctacgccaccggcgacatcatcggcgacatccggcaggcccactgcaacatcaacgagtcgaagtggaacgagaccctgcagaaggtgggcaacgagctgcagaagcacttccccaacaagaccatcaagtacgagcaggcggccggcggcgacatggagatcaccacgcactccttcaactgcggtggcgagttcttctactgcaacacggccaacctgttcaacggcacgtacaacgggaccgacatctccacgaactcgtccgccaactcgacgtccacgatcacgctccagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgagacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcgccagcaggagcggaacgagaaagacctgctcgcgctggactcgtggaactcgctgtggaactggttcaacatcaccaactggctgtggtacatcaagtagtgagaattcggtaaccgggtcccggatcc

SEQ ID NO: 623 - DNA, 2096 bp, Artificial Sequence
  Description of Artificial Sequence: Synthetic polynucleotide
ggtcgacaagaagccaccatgcgcgtgacgggcatcctgaagaactacccgcggtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactcgaccaccgaggagatgtccaacgccacggtgaagaactccacgacggaggagatgaagaactgctccttcaacaccacgacggagatccgcgacaaggagaagaaggagtacgccctgttctaccgccccgacgtcgtgccgctggacgagacgaacaacacgtccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccgctacaaccagtccgccggcggcgacatggagatcaccacgcactccttcaactgcggtggcgagttcttctactgcaacacggccaagctgttcaactccacgtacaacgacacctacaagtccacgaactcgtccgccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtcgaacgagacggagaccttcaggccagcgggaggcgacaactggcgctccgagctgtacaagtacaaggtggtggaggtccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttctccatcaccaagtggctgtggtacatcaagtagtgagaattcggtaaccaggacccggatcc

SEQ ID NO: 624 - DNA, 2123 bp, Artificial Sequence
  Description of Artificial Sequence: Synthetic polynucleotide
ggtcgacaagaagccaccatgcgcgtgacgggcatcctgaagaactacccgcggtggtggatctggggcatcctgggcttctggatgctcatgaactgcaacggcgagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgacaccgtgaccaacatcacgaacacgatcaaggaggaggtgaagaactgctccttcaagaccacgacggagatccgcgacaaggagaagaaggagcacgccctgttctaccgccccgacatcgtgccgctgaactccgagacgggcaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagaccatcatcgtgcacctgcacacgccggtggagatcgtgtgcacccgcccgggcaacaacacgcgcaagtccatgcggatcggccctggccagaccttctacgccaccggcgacatcatcggcgacatccggcaggcccactgcaacatctcggaggagaagtggaacaagaccctgcaggaggtgggcaaggagctgcagaagcacttccccaaccggaccatcaagtacaaccagtccgccggcggcgacatggagatcaccacgcactccttcaactgcggtggcgagttcttctactgcaacacgtccaagctgttcaactccacgtacaacgacacctacatctccacgaactcgaccaactcgtccgccaacaactcgtccatcatcacgctccagtgccggatcaagcagatcatcaacatgtggcagggggtgggccgcgctatgtacgcaccgcccatcgccggcaacatcatctgcaagtccaacatcaccggcctcctgctgacccgcgacggcggcccggactcgaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagtagtgagaattcggtaaccaggtcccggatcc

SEQ ID NO: 625 - DNA, 2117 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccaacccgcaggagatgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccacggtcaactccaccaccgactacgactcccggtccaacgactccgtgaccaacatcacgaacacgatcaaggaggaggtgaagaactgctccttcaagaccacgacggagatccgcgacaaggagaagaaggagcacgccctgttctaccgccccgacatcgtgccgctcaactccgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgcgaagatcatcatcgtgcagctgaacacgtccgtggagatcgtgtgcacccgcccgggcaacaacacgcgcaagtccgtgcggatcggccctggccagaccttctacgccaccggcgacatcatcggcgacatccggcaggcccactgcaacatctcggagaagaagtggaacgagaccctgcagcgggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatcaacacgacctcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagtagtgagaattcggtaaccgggacctggatcc

SEQ ID NO: 626 - DNA, 2066 bp, Artificial Sequence
  Description of Artificial Sequence: Synthetic polynucleotide
ggtcgacaagaagccaccatgcgcgtgacgggcatcctgaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaccgccacggtgaacaactccacggtggacgagatgaagaactgctccttcaacgccacgacggagatccgcgacaagaagaagaaggagtacgccctgttctaccgctcggacgtcgtgtccctggacgagacgaacaacacgtccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagacgatcatcgtgcacctgcacgccccggtggagatcgtgtgcacccgcccgggccacaacacgcgcaagtccgtgcggatcggccctggccagaccttctacgccaccggcgacatcatcggcaacatccggcaggcccactgcaacatcaacgagtcggagtggaacgagaccctgcagaaggtgggcaaggagctgcgcaagcacttccccaacaagaccatcaagtacgagcagtccgccggcggcgacatggagatcaccacgcactccttcaactgcggtggcgagttcttctactgcaacacggccaacctgttcaacggcacgtacaacgggaccgacatctccacgaactcgtccgccgaccgcaactccacgatcacgctcgagtgcaagatcaagcagatcatcaacatgtggcagggggtgggccgcgctatgtacgcaccgcccatcgccggcaacatcacctgccgctccaacatcaccggcctcctgctgacccgcgacggcggcatcaacaacgtgtcgaacgccacggagaccttcaggccagcgggaggcgacatgcgcgacaactggcgctccgagctgtacaagtacaaggtggtggaggtccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctggaacaacatgacctggatgcagtgggagcgcgagatctccaactacaccgagaccatctacatgctcctcgaggactcccagcgccagcaggagcggaacgagaaagacctgctcgcgctggactcgtggaactcgctgtggaactggttcaacatcaccaactggctgtggtacatcaagtagtgagaattcggtaaccgggtcctggatcc

SEQ ID NO: 627 - DNA, 2087 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgagaactccacggaggccatgaagaactgctccttcaacaccacgacggagatccgcgacaagatcaagaaggagcgggccctgttctaccgccccgacatcgtgccgctcaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagtagtgagaattcggttaccgggtcccggatcc

SEQ ID NO: 628 - DNA, 2105 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgtccaacgtcaccgtcaacaacatcaccatcgaggagatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacgccccggtggagatcgtgtgcacccgcccgtacaacaacacgcgcaagtccgtgcggatcggccctggccagaccttctacgccaccggcgacatcatcggcgacccgcggcaggcccactgcaacatctcgaaggagatctggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgcaagatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggaacaacatgacctggatgcagtgggagcgcgagatctccaactacaccgggaccatctacaagctcctcgaggactcccagaaccagcaggagcggaacgagaaggatctgctcgcgctggactcgtggaactcgctgtggtcgtggttcaacatcaccaagtggctgtggtacatcaagtagtgagaattcggttaccaggacccggatcc

SEQ ID NO: 629 - DNA, 2111 bp, Artificial Sequence
  Description of Artificial Sequence: Synthetic polynucleotide
ggtcgacaagaagccaccatgcgcgtgatgggcatcctgaagaactacccgcggtggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacgaactcgatcaactcgacgctgaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggagtcccagaaccagcaggagcggaacgagcaagacctgctcgcgctggactcgtggaactcgctgtggaactggttcaacatcaccaagtggctgtggtacatcaagtagtgagaattcggttaccaggtcccggatcc

SEQ ID NO: 630 - DNA, 2105 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgaggagatcagcaacgccaccgtcaagaacatcaccatcaaggagatgaagaactgctccttcaacaccacgacggagatccgcgacaagatcaagaaggagcgggccctgttctaccgcaccgacatcgtgccgctgaacaaggagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggcaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctcccccaactcgaccaactcgacgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcatcaacaacgtgtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcggcaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctggaacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttcgacatcaccaagtggctgtggtacatcaagtagtgagaattcggttaccgggacctggatcc

SEQ ID NO: 631 - DNA, 2108 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccacgaccgagaagatgagcaacgtcaccgtcaacaacatcaccatcgaggagatgaagaactgctccttcaacaccacgacggagatccgcgacaagatcaagaaggagcgggccctgttctaccgcccggacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagaccatcatcgtgcacctgcacgccccggtggagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccaccaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggcccggacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggtcggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcctggttcaacatcaccaagtggctgtggtacatcaagtagtgagaattcggttaccgggtcctggatcc

SEQ ID NO: 632 - DNA, 2111 bp, Artificial Sequence
  Description of Artificial Sequence: Synthetic polynucleotide
ggtcgacaagaagccaccatgcgcgtgatgggcatcctgaagaactacccgcggtggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagctgtccaacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacgaccaagctgttcaactccacgtacaacggcacctacatctccacgaactcgatcaactcgacgctgaacatcacgctccagtgccggatcaagcagatcatcaacatgtggcaggggatcggccgcgctatgtacgcaccgcccatcgccggcaacatcacctgccggtccaacatcaccggcctcctgctgacccgcgacggcggcatccacaacgactccaacgagacggagaccttcaggccagcgggaggcgacatgcgggacaactggcgctccgagctgtacaagtacaaggtggtggagatccagcccctgggcatcgcacccaccggggccaaggagcgggtcgtggagcgcgggaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctgggacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttcgacatcaccaagtggctgtggtacatcaagtagtgaggtgaccgggacccgaattcggatcc

SEQ ID NO: 633 - DNA, 2078 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccacggtcgagaactccacggaggccatgaagaactgctccttcaacaccacgacggagatccgcgacaagatcaagaaggagcgggccctgttctaccgccccgacatcgtgccgctcaacaacgagacgggcaacatctccgagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacaacccggtggagatcgtgtgcacccgcccgtacaacaacacgcgcaagtccgtgcggatcggccctggccagaccttctacgccaccggcgacatcatcggcgacccgcggaaggcccactgcaacatctcgaaggaggagtggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaacctgttcaactccacgtacaacgacacctacatctccccgaactcgaccaactcgacctccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgagtccaacgagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagtagtgaggtcaccgggacccgaattcggatcc

SEQ ID NO: 634 - DNA, 2087 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggacccctcgccgcaggagctgttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtcaagaactccaacgccaccgtcgggaactccacggaggccatgaagaactgctccttcaacaccacgacggagatccgcgacaagatcaagaaggagcgggccctgttctaccgccccgacatcgtgccgctgaacgacgagacgaacaacacctccaagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgtgaagatcatcatcgtgcacctgcacacgccggtgcagatcgtgtgcacccgcccgtacaacaacacgcgcaagtccgtgcggatcggccctggccagaccttctacgccaccggcgacatcatcggcgacccgcggaaggcccactgcaacatctcggagaaggactggaacaagaccctgcaggaggtgggcaaggagctgcagaagcacttccccaacaagaccatccggtacaaccagtccgccggcggcgacatggagatcaccacgcactccttcaactgcggtggcgagttcttctactgcaacacgtccaagctgttcaactccacgtacaacgacacctacatctccacgaactcgaccaactcgtcggccaacaactcgtccatcatcacgctccagtgccggatcaagcagatcatcaacatgtggcagggggtgggccgcgctatgtacgcaccgcccatcgccggcaacatcacctgcaagtccaacatcaccggcctcctgctgacccgcgacggcggccccgacaacaagacggagaccttcaggccagcgggaggcgacatgcgggacaactggcgctccgagctgtacaagtacaaggtggtggaggtccagcccctgggcatcgcacccaccggggccaaggagcgggtcgtggagcgcgagaaggaggcggtgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaagacctgctcgcgctggactcgtggaactcgctgtggtcgtggttcaacatcaccaagtggctgtggtacatcaagtagtgaggtaaccgggacccgaattcggatcc

SEQ ID NO: 635 - DNA, 2111 bp, Artificial Sequence
  Description of Artificial Sequence: Synthetic polynucleotide
ggtcgacaagaagccaccatgcgcgtgacgggcatcctgaagaactgcccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtccggaactccacgaccgagaagatgtccgacgcgctggaccgcaactcgacgaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcgaaggaggagatcgtcatccggtccgagaacctcacgaacaacgccaagatcatcatcgtgcagctgaacgcgaacgcctccgtggagatcgtgtgcacccgcccgaacaacaacacgcgcaagtccgtgcggatcggccctggccagaccttctacgccaccggcgacatcatcggcgacatccggcaggcccactgcaacatctcggagaagaagtggaacgagaccctgcagcaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacggactcgatcaactcgaccctcaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgtgacggagaccttcaggccagcgggaggcgacatgcgggacaactggcgctccgagctgtacaagtacaaggtggtggagatccagcccctgggcatcgcacccaccggggccaaggagcgggtcgtggggcgcgagaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggagtcccagaaccagcaggagcggaacgagcaagacctgctcgcgctggactcgtggaactcgctgtggtcgtggttcaacatcaccaagtggctgtggtacatcaagtagtgaggttaccgggacccgaattcggatcc

SEQ ID NO: 636 - DNA, 2068 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaacctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggagaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgtcaacgtgacgcggtcgaacgtgaacgtcacgaacatcacgaacacgatcaagggcgagatgaagaactgctccttcaacacgacgacggagatccgcgacaaggagaagaaggagtacgccctgttctaccgctcggacgtggtgccgctgaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacaagaccctgcacgaggtgtcgaaggagctgcagaagcacttccccaacaagacgattaagtacgcgcagtcggccggcggcgacatggagatcaccacgcactccttcaactgcggtggcgagttcttctactgcaacacgtcgaacctgttcaacggcacctacaacggcacctacatctcgacgaactcgtccgcgaactccaacagcacgatcacgctccagtgccgcatcaagcagatcatcaacatgtggcagggggtgggccgcgctatgtacgcaccgcccatcgccggcaacatcacctgccgctccaacatcaccggcctcctgctgacccgcgacggcggcaccaagaacaacaagacggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaactggctgtggtacatcaagtagtaagggatcc

SEQ ID NO: 637 - DNA, 2032 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaaggggaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtcctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccatgggggagatgaagaactgctccttcaacacgacgacggagatccgcgacaaggagaagaaggagtacgccctgttctacaagcccgacgtcgtgccgctggacgagaccaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacggcaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcggcatcatcggcgacatccgccaggcccactgcaacatcagcgaggggcagtggaacgagaccctgcagaaggtgggcaaggagctgcagaagcacttccccaacaagacgattaagtacgagcagtcggccggcggcgacatggagatcaccacgcactccttcaactgcggtggcgagttcttctactgcaacacgtcgaagctgttcaacggcacgtacaacggcacctacatctccacgaactcgtccaccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctcggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 638 - DNA, 2089 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgaactgcaacggcaaggagaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgactacgacacgcggtccaacgtgaacgtgaccaacatcacgaacacgatcaagggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgtcggtggagatcgtgtgcacccgcccgggcaacaacacgcgcaagtccgtccggatcggccctggccagaccttctacgccaccggcgacatcatcggcgacatccgccaggcccactgcaacatcagcgagtcgaagtggaacgagaccctgcagaaggtgggcatcgagctgcagaagcacttccccaacaagacgattaagtacgagcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacagctccgaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacctcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 639 - DNA, 2095 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaaggggaagctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcgtgctggggaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaacaaccgcaccgtctacgactcgcggtccaacgacaacgtgacctcgatcaacaacacgatcatgggggagatgaagaactgctccttcaacacgacgacggagatccgcgacaaggagaagaaggagtacgccctgttctaccgccccgacatcgtgccgctgaacgagaacgagaccagcaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgggcaacaacacgcgcaagtccgtccggatcggccctggccagaccttctacgccaccggcgacatcatcggcgacatccgccaggcccactgcaacatcagcgaggagaagtggaacgagaccctgcagaaggtgggcatcgagctgcagaagcacttccccaacaagacgattaagtacgagcagtcggccggcggcgacatggagatcaccacgcactccttcaactgcggtggcgagttcttctactgcaacacgtcgaacctgttcaacggcacgtacaacggcacctacatctccacgaactcgtccgccaactcgacgagcacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaacaacaccagcaacgaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccgccgtggcgtggaacacctcctggtccaacaagtcggagaaggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 640 - DNA, 2041 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcgagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggacaaccgcaccgtcggggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgaggagaagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccaccaactcgaaccccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 641 - DNA, 2041 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcgagggcaacctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaactccaccgtcgaggagatgaagaactgctccttcaacacgacgacggagatccgcgacaaggagaagaaggagtacgccctgttctaccgcccggacatcgtgccgctgaacaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagtccaagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggcgaagctgttcaacgggacgtacaacggcacggacatctccacgaactcctcgacgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaactcgagcgggaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 642 - DNA, 2044 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaaggagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaacacgtcgaacctgttcaacggcacgtacaacggcaccgacatctcgacgaactcgtccgcgaagtcgaactcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaactcgtcgaagacggaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctgggacaacatgacctggatgcagtgggagcgcgagatctccaactacaccgagaccatctacatgctcctcgaggactcccagcgccagcaggagcggaacgagaaggatctgctcgcgctggactcgtggaactccctgtggaactggttcaacatcaccaagtggctgtggtacatcaagtagtaagggatcc

SEQ ID NO: 643 - DNA, 2047 bp, Artificial Sequence
  Description of Artificial Sequence: Synthetic polynucleotide
ggtcgacaagaaatgcgcgtgatgggcatcctcaagaactacccgcagtggtggatctggggcatcctgggcttctggatgctcatgatctgcaacggcaagggcaagctctgggtgacggtctactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtggacaactcgacggtggaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgagatccgccaggcccactgcaacatcagcgaggaggagtggaacgagaccctgcagaaggtgggcaaggagctgcagaagcacttccccaacaagaccattaagtacgagcagtcggccggcggcgacatggagatcaccacgcactccttcaactgcggtggcgagttcttctactgcaacacggccaacctgttcaacgggacgtacaacggcaccgacatctccacgaactcctcgacgaagtcgaactcgacgatcacgctccagtgccgcatcaagcagatcatcaacatgtggcagggggtgggccgcgctatgtacgcaccgcccatcgccggcaacatcacctgcaagtccaacgtgaccggcctcctgctgacccgcgacggcggcaccaactcgtcgcagaccgaggaggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 644 - DNA, 2032 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacgcgcccgtggagatcgtgtgcacccgcccgaacaacgacacgcgcaagtccgtccggatcggccctggccagaccttctacgccaccggcgacatcatcggcgacatccggcaggcccactgcaacatcagcgagaaggagtggaacgagaccctgcagaaggtgggcatcgagctgcagaagcacttccccaacaagaccattaagtacgagcagtcggccggcggcgacatggagatcaccacgcactccttcaactgcggtggcgagttcttctactgcaacacgtcgaagctgttcaacggcacgtacaacggcacctacatcaacacgtcgtcgaactcgacgatcacgctccagtgccgcatcaagcagatcatcaacatgtggcagggggtgggccgcgctatgtacgcaccgcccatcgccggcaacatcacctgcaagtccgacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 645 - DNA, 2041 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacacggtcaacaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgagaaggagtggaacgagaccctgcagaaggtgggcaaggagctgcagaagcacttccccaacaagaccattaagtacgcgcagtcggccggcggcgacatggagatcaccacgcactccttcaactgcggtggcgagttcttctactgcaacacggccaacctgttcaacggcacgtacaacggcaccgacatctcgacgaactcctcgacgaagtcgaactcgacgatcacgctccagtgccgcatcaagcagatcatcaacatgtggcagggggtgggccgcgctatgtacgcaccgcccatcgccggcaacatcacctgccgctccacgatcaccggcctcctgctgacccgcgacggcggcaactcgtcgaagaccgaggaggagacgttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcgaagacggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 646 - DNA, 2041 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacacggtcaacaaccgcaccgtctacgagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcagctgaacacgtcggtggagatcgtgtgcacccgcccgaacaacaacacgcgcaagtccgtccggatcggccctggccagaccttctacgccaccggcgacatcatcggcgagatccggcaggcccactgcaacatcagcgaggaggagtggaacgacaccctgcagaaggtgggcaaggagctgcagaagcacttccccaacaagaccattgagtacaagcagtcggccggcggcgacatggagatcaccacgcactccttcaactgcggtggcgagttcttctactgcaacacggccaagctgttcaacgggacgtacaacggcacggacatctccacgaactcctcgacgaactcgaacccgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcaactcgtcgaagacggaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgggaccatctacaagctcctcgaggactcccagaaccagcaggagcggaacgagcaggagctgctcgcgctggactcgtggaactccctgtggaactggttcaacatcaccaagtggctgtggtacatcaagtagtaagggatcc

SEQ ID NO: 647 - DNA, 2035 bp, Artificial Sequence
  Description of Artificial Sequence: Synthetic polynucleotide
ggtcgacaagaaatgcgcgtgatgggcatcctcaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaacaagacggtggaggagatgaagaactgctccttcaacacgacgacggagatccgcgacaaggagaagaaggagtacgccctgttctacaagccggacgtcgtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtaagggatcc

SEQ ID NO: 648 - DNA, 2035 bp, Artificial Sequence
  Description of Artificial Sequence: Synthetic polynucleotide
ggtcgacaagaaatgcgcgtgatgggcatcctcaagaactacccgcagtggtggatctggggcatcctgggcttctggatgctcatgatctgcaacggcaagggcaagctctgggtgacggtctactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaacgggacggtggaggagatgaagaactgctccttcaacacgacgacggagatccgcgacaaggagaagaaggagtacgccctgttctacaagccggacatcgtgccgctgtcggagacgaacaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatcaagcaggcccactgcaacatcagcgaggagaagtggaacgacaccctgcagaaggtgggcatcgagctgcagaagcacttccccaacaagaccattaagtacaaccagtcggccggcggcgacatggagatcaccacgcactccttcaactgcggtggcgagttcttctactgcaacacgtcgaacctgttcaacgggacgtacaacggcacctacatctccacgaactcctcggcgaactcgacctcgacgatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcaccaactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaccgacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttctcgatcaccaagtggctgtggtacatcaagtagtaagggatcc

SEQ ID NO: 649 - DNA, 2038 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgcggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 650 - DNA, 2038 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgcccgcgcctacgagaaggaggtgcacaacgtgtgggcgacccacgcctgcgtgcccacggaccccaacccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccataaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgccgactcgaacagcacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcgagaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagaaggatctgctcgcgctggactcgtggaactccctgtggaactggttcaacatcaccaagtggctgtggtacatcaagtagtaagggatcc

SEQ ID NO: 651 - DNA, 2038 bp, Artificial Sequence
  Description of Artificial Sequence: Synthetic polynucleotide
ggtcgacaagaaatgcgggtgatgggcatccccaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccaacccgcaggagctcgtgctgggcaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctacaagccggacgtggtgccgctggacgagacgaacaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgaacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgaagaagcacttccccaacaagaccattaagtacgcgcagtcggccggcggcgacatggagatcaccacgcactccttcaactgcggtggcgagttcttctactgcaacacggcgaagctgttcaacggcacgtacaacggcaccgacatctcgacgaactcgtccgccgactcgaacagcacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcgagaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagaaggacatctgggacaacatgacctggatgcagtgggagcgcgagatctccaactacaccgagaccatctacaagctcctcgaggactcccagaaccagcaggagcggaacgagaaggatctgctcgcgctggactcgtggaactccctgtggaactggttcaacatcaccaagtggctgtggtacatcaagtagtaagggatcc

SEQ ID NO: 652 - DNA, 2038 bp, Artificial Sequence
  Description of Artificial Sequence: Synthetic polynucleotide
ggtcgacaagaaatgcgggtgatgggcatcctcaagaactacccgcagtggtggatctggggcatcctgggcttctggatgctcatgatctgcaacggcaagggcaagctctgggtgacggtgtactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacctcaacatgtggaagaacgacatggtggaccagatgcacgaggacatcatctccctgtgggaccagtccctgaagccctgcgtgaagctgaccccgctgtgcgtgaccctgatctgctcgaacgccacggtgaagaaccgcaccgtcgaggagatgaagaactgctccttcaacacgacgacggagatccgcgacaaggagaagaaggagtacgccctgttctaccgcccggacatcgtgccgctgaacgagaacgagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacaacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcgacatcatcggcgacatccggcaggcccactgcaacatcagcgagaagcagtggaacgacaccctgcagaaggtgggcaaggagctgcagaagcacttccccaacaagaccattaagtacaagcactcggccggcggcgacatggagatcaccacgcactccttcaactgcggtggcgagttcttctactgcaacacgtcgaacctgttcaacggcacgtacaacggcacctacatgaacatctcgacggactcgaactcgacgatcacgctccagtgccgcatcaagcagatcatcaacatgtggcagggggtgggccgcgctatgtacgcaccgcccatcgccggcaacatcacctgcaagtcccacatcaccggcctcctgctgacccgcgacggcggcacgaactcgagcggcaaggaggagatcttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagacggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 653 - DNA, 2041 bp, Artificial Sequence
  Description of Artificial Sequence: Synthetic polynucleotide
ggtcgacaagaaatgcgcgtgatgggcatccccaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgacggccacggtgaacaagtccacggtggaggagatgaagaactgctccttcaacacgacgacggagatccgcgacaaggagaagaaggagtacgccctgttctaccgcccggacatcgtgccgctgaacaacaagacgtcgaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggaggaggagatcgtcatccggtccgagaacctcacgaacaacgcgaagatcatcatcgtgcacctgcacacgcccgtggagatcgtgtgcacccgcccgaacaacaacacgcgcaagtccgtccggatcggccctggccagaccttctacgccaccggcggcatcatcggcgacgtgcgccaggcccactgcaacatcagcaagggcctctggaacgacaccctgcagaaggtgggcaaggagctgcagaagcacttccccaacaagaccattcgctacaaccagtcggccggcggcgacatggagatcaccacgcactccttcaactgcggtggcgagttcttctactgcaacacggccaagctgttcaacgggacgtacaacggcaccgacatctccacgaactcctcggcgaacaactcgtccacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcatcaactcgtcgcgcgaggaggagatcttcaggccagcgggaggcgacatgcgcgacaactggcgctccgagctgtacaagtacaaggtggtggaggtgcagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatgtggggctgctccggcaagctgatctgcacgaccaacgtgccctggaacacgtcctggtccaacaagtcggagatggacatctgggacaacatgacctggatgcagtgggagcgcgagatctccaactacaccgagaccatctacaagctcctcgaggactcccagaaccagcaggagcggaacgagcaggatctgctcgcgctggactcgtggaactccctgtggaactggttcaacatcaccaagtggctgtggtacatcaagtagtaagggatcc

SEQ ID NO: 654 - DNA, 2041 bp, Artificial Sequence
  Description of Artificial Sequence: Synthetic polynucleotide
ggtcgacaagaaatgcgcgtgatgggcatccccaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggacgagatgaagaactgctccttcaacacgacgacggagatccgcgacaaggagaagaaggagcgcgccctgttctaccgcccggacatcgtgccgctgaacaacgagacgggcaacacctcggagtacaggctgatcaactgcaacacctccgcgatcacgcaggcgtgccccaaggtcacgttcgagcccatccccatccactactgcgcccccgccggctacgccatcctgaagtgcaacgacgagaccttcaacgggaccggcccgtgcagctcggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgaacgcctccgtggagatcgtgtgcacccgcccgaacaacaacacgcgcaagtccgtccggatcggccctggccagaccttctacgccaccggcgacatcatcggcgacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctggggcaacatgacctggatgcagtgggagcgcgagatctccaactacaccgagaccatctacaagctcctcgaggactcccagaaccagcaggagcggaacgagcaggatctgctcgcgctggactcgtggaactccctgtggtcgtggttcaacatcaccaagtggctgtggtacatcaagtagtaagggatcc

SEQ ID NO: 655 - DNA, 2041 bp, Artificial Sequence
  Description of Artificial Sequence: Synthetic polynucleotide
ggtcgacaagaaatgcgcgtgatgggcatccccaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtggagaactcgacgacggacgagatgaagaactgctccttcaacacgacgacggagatccgcgacaaggagaagaaggagcgcgccctgttctaccgcccggacatcgtgccgctgaacaacgagacgggcaacacctcggagtacaggctgatcaactgcaacacctccgcgatcacgcaggcgtgccccaaggtcacgttcgagcccatccccatccactactgcgcccccgccggctacgccatcctgaagtgcaacgacgagaccttcaacgggaccggcccgtgcagctcggtgtccaccgtgcagtgcacgcacggcatccggcccgtggtgtccacgcagctgctcctgaacgggtcgctggcggagaaggggatcgtcatccggtccgagaacctcacgaacaacgcgaagatcatcatcgtgcacctgaacgcctccgtggagatcgtgtgcacccgcccgaacaacaacacgcgcaagtccgtccggatcggccctggccagaccttctacgccaccggcgacatcatcggcgacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggagatccagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggagaacatgacctggatgcagtgggagcgcgagatctccaactacaccgagaccatctacaagctcctcgaggactcccagaaccagcaggagcggaacgagcaggatctgctcgcgctggactcgtggaactccctgtggtcgtggttcaacatcaccaagtggctgtggtacatcaagtagtaagggatcc

SEQ ID NO: 656 - DNA, 2041 bp, Artificial Sequence
  Description of Artificial Sequence: Synthetic polynucleotide
ggtcgacaagaaatgcgcgtgatgggcatccccaagaactacccgcgctggtggatctggggcatcctgggcttctggatgctcatgatctgcaacggcaagggcaagctctgggtgacggtctactacggcgtgccggtgtggaaggaggccaagacgaccctgttctgcgcgtcggacgccaaggcctacgtgaaggaggtgcacaacatctgggcgacccacgcctgcgtgcccacggaccccagcccgcaggagctcctcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccacggtgaaccagtccacgacggaggagatgaagaactgctccttcaacacgacgacggagatccgcgacaaggagaagaaggagcacgccctgttctaccgcccggacatcgtgccgctggacaacgagacgggcaacacctcggagtacaggctgatcaactgcaacacctccgcggtcacgcaggcgtgccccaaggtcacgttcgagcccatccccatccactactgcgcccccgccggctacgccatcctgaagtgcaacgacgagaccttcaacgggaccggcccgtgcagcaaggtgtccaccgtgcagtgcacgcacggcatccggcccgtggtgtccacgcagctgctcctgaacgggtcgctggcggagaaggggatcgtcgtgcggtccgagaacctcacgaacaacgcgaagatcatcatcgtgcagctgaacgcctccgtggagatcgtgtgcacccgcccgaacaacaacacgcgcaagtccgtccggatcggccctggccagaccttctacgccaccggcgacatcatcggcaacatccgccaggcccactgcaacatcagcgagaagaagtggaacgagaccctgcagaaggtgggcatcgagctgcagaagcacttccccaacaagaccattaagtacaaccagtcggccggcggcgacatggagatcaccacgcactccttcaactgcggtggcgagttcttctactgcaacacggccaagctgttcaactcgacgtacaacggcacctacatctccacgaactccatcaactcgaccctgaacatcacgctccagtgccgcatcaagcagatcatcaacatgtggcagggggtgggccgcgctatgtacgcaccgcccatcgccggcaacatcacctgccggtccaacatcaccggcctcctgctgacccgcgacggcggcatccacaacgactcgaacgagacggagaccttcaggccagcgggaggcgacatgcgcgacaactggcgctccgagctgtacaagtacaaggtggtggaggtgcagcccctgggcatcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagaccgacatctgggagaacatgacctggatgcagtgggagcgcgagatctccaactacaccgagaccatctacaagctcctcgaggactcccagaaccagcaggagcggaacgagcaggatctgctcgcgctggactcgtggaactccctgtggtcgtggttcaacatcaccaagtggctgtggtacatcaagtagtaagggatcc

SEQ ID NO: 657 - DNA, 2086 bp, Artificial Sequence
  Description of Artificial Sequence: Synthetic polynucleotide
ggtcgacaagaaatgcgcgtgatgggcatcccgaagaactacccgctctggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacgtgaaggaggtgcacaacgtgtgggcgacccacgcctgcgtgcccacggacccctcgccgcaggagctggtcctggacaacgtgaccgagaacttcaacatgtggaagaacgacatggtggaccagatgcacgaggacatcatctccctgtgggaccagtccctgaagccctgcgtgaagctgaccccgctgtgcgtgaccctgaactgctcgaacgccatcgtcaagaactccacgaccgaggagatctcccacgccctcgcgcggaactcgaccaccgaggagatgaagaactgctccttcaacaccacgacggagatccgcgacaaggagaagaaggagtacgccctgttctaccgccccgacatcgtgccgctgaacaacaagacgtccaacatctccgagtacaggctgatcaactgcaacacctccaccgtcacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaagggcatcgtcatccggtccgagaacctcacgaacaacgcgaagatcatcatcgtgcagctgaacgccaacgcctcggtggagatcgtgtgcacccgcccgaacaacaacacgcgcaagtccgtgcggatcggccctggccagaccttctacgccaccggcgacatcatcggcaacatccggcaggcccactgcaacatctcggagaagaagtggaacgagaccctgcagaaggtgggcatcgagctgcagaagcacttccccaacaagaccatcaagtacaaccagtccgccggcggcgacatggagatcaccacgcactccttcaactgcggtggcgagttcttctactgcaacacggccaagctgttcaactccacgtacaacggcacctacatctccacgaactcgatcaactcgacgctgaacatcacgctccagtgccggatcaagcagatcatcaacatgtggcagggggtgggccgcgctatgtacgcaccgcccatcgccggcaacatcacctgccggtccaacatcaccggcctcctgctgacccgcgacggcggcatccacaacgactccaacgtgacggagaccttcaggccagcgggaggcgacatgcgggacaactggcgctccgagctgtacaagtacaaggtggtggagatccagcccctgggcatcgcacccaccggggccaaggagcgggtcgtggagcgcgggaaggaggcggccggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctggaacaacatgacctggatgcagtgggagcgcgagatctccaactacaccgggaccatctacaagctcctcgaggactcccagaaccagcaggagcggaacgagcaagacctgctcgcgctggactcgtggaactcgctgtggaactggttcgacatcaccaagtggctgtggtacatcaagtagtaagggatcc

SEQ ID NO: 658 - DNA, 2077 bp, Artificial Sequence
  Description of Artificial Sequence: Synthetic polynucleotide
ggtcgacaagaaatgcgcgtgatgggcatcctcaagaactacccgcagtggtggatctggggcatcctgggcttctggatgctcatgaactgcaacggcgagggcaacctctgggtgacggtctactacggcgtgccggtgtggaaggaggccaagacgaccctgttctgcgcgtcggacgccaaggcctacaagaaggaggtgcacaacgtgtgggcgacccacgcctgcgtgcccacggaccccagcccgcaggagctcttcctgaagaacgtgaccgagaacttcaacatgtggaagaacgacatggtggaccagatgcacgaggacatcatctccctgtgggaccagtccctgaagccctgcgtgaagctgaccccgctgtgcgtgaccctgatctgctcgaacgccatcgtgaagaactcgacgaccgaggagatgtccaacgccacggtgaagaactcgacgacggaggagatgaagaactgctccttcaacacgacgacggagatccgcgacaaggagaagaaggagtacgccctgttctaccgcccggacgtggtcccgctggacgagacgaacaacacctcgaagtacaggctgatcaactgcaacacctccgcggtgacgcaggcgtgccccaaggtcacgttcgagcccatccccatccactactgcgcccccgccggctacgccatcctgaagtgcaacgacgagaccttcaacgggaccggcccgtgcagcaacgtgtccaccgtgcagtgcacgcacggcatccggcccgtggtgtccacgcagctgctcctgaacgggtcgctggcggagaaggagatcgtcatccggtccgagaacctcacgaacaacgcgaagacgatcatcgtgcacctgcacaccccggtggagatcgtgtgcacccgcccgtacaacaacacgcgcaagtccgtccggatcggccctggccagaccttctacgccaccggcgacatcatcggcgacccgcgccaggcccactgcaacatcagcaaggagacctggaacaagaccctgcaggaggtgggcaaggagctgcagaagcacttccccaacaagaccattcgctacaaccagtcggccggcggcgacatggagatcaccacgcactccttcaactgcggtggcgagttcttctactgcaacacgtccaacctgttcaactcgacgtacaacgacacctacatctccccgaactccaccaactcgacctcgacgatcacgctccagtgccgcatcaagcagatcatcaacatgtggcagggggtgggccgcgctatgtacgcaccgcccatcgccggcaacatcacctgcaagtccaacatcaccggcctcctgctgacccgcgacggcggcacgaccaacaactcgaacgagacggagaccttcaggccagcgggaggcgacatgcgcgacaactggcgctccgagctgtacaagtacaaggtggtggaggtccagcccctgggcctcgcacccaccggggccaaggagcgggtcgtggagcgcgagaaggaggcggcgggcctcggcgccctgttcctgggcttcctgggcgctgcgggctccaccatgggtgccgcgtccatcaccctgaccgtgcaggcccgccagctgctctccggcatcgtgcagcagcagtccaacctcctgagggccatcgaggcccagcagcacatgctgcagctgaccgtgtggggcatcaagcagctgcaggccagggtgctcgcgctcgagcgctacctgaaggaccagcagctgctcggcatctggggctgctccggcaagctgatctgcacgaccaacgtgccctggaacacgtcctggtccaacaagtcggagatggacatctggggcaacatgacctggatgcagtgggagcgcgagatctccaactacaccgggaccatctacaagctcctcgaggactcccagaaccagcaggagcggaacgagcaggatctgctcgcgctggactcgtggaacaacctgtggaactggttctccatcaccaagtggctgtggtacatcaagtagtaagggatcc

SEQ ID NO: 659 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTHSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 660 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASNAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 661 - protein, 9 aa, Artificial Sequence
  Description of Artificial Sequence: Synthetic peptide
  MOD_RES (9)..(9): Any amino acid
GDRIRDPDX

SEQ ID NO: 662 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 663 - protein, 10 aa, Artificial Sequence
  Description of Artificial Sequence: Synthetic peptide
  MOD_RES (9)..(10): Any amino acid
GHRIRDPDXX

SEQ ID NO: 664 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 665 - protein, 10 aa, Artificial Sequence
  Description of Artificial Sequence: Synthetic peptide
  MOD_RES (9)..(10): Any amino acid
GNRIRDPDXX

SEQ ID NO: 666 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWSKTLQEVGKELQKHFPNKTIKYERSAGGDMEIATHSFNCGGEFFYCNTSNLFNGTYNGTYISANSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 667 - protein, 9 aa, Artificial Sequence
  Description of Artificial Sequence: Synthetic peptide
  MOD_RES (9)..(9): Any amino acid
GYRIRDPDX

SEQ ID NO: 668 - protein, 686 aa, Artificial Sequence; identical to SEQ ID NO: 281
  Description of Artificial Sequence: Synthetic polypeptide

SEQ ID NO: 669 - protein, 9 aa, Artificial Sequence
  Description of Artificial Sequence: Synthetic peptide
  MOD_RES (9)..(9): Any amino acid
GDRIRVPDX

SEQ ID NO: 670 - protein, 686 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELGLENVTENFNMWKNDMVDQMHEDIISLWDQSLKPCVKLTPLCVTLKCSNAIVDSSKVYDTRSKVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWDTNWSNKSEKDIWDNMTWMQWEREISNYTETIYKLLEDSQHQQERNEQDLLALDSWNSLWNWFNITNWLWYIK

SEQ ID NO: 671 - protein, 9 aa, Artificial Sequence
  Description of Artificial Sequence: Synthetic peptide
  MOD_RES (9)..(9): Any amino acid
GDRIQDPDX

SEQ ID NO: 672 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 673 - protein, 9 aa, Artificial Sequence
  Description of Artificial Sequence: Synthetic peptide
  MOD_RES (9)..(9): Any amino acid
GDRIQVPDX

SEQ ID NO: 674 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGHITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 675 - protein, 9 aa, Artificial Sequence
  Description of Artificial Sequence: Synthetic peptide
  MOD_RES (9)..(9): Any amino acid
GDRIRDLDX

SEQ ID NO: 676 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 677 - protein, 9 aa, Artificial Sequence
  Description of Artificial Sequence: Synthetic peptide
  MOD_RES (9)..(9): Any amino acid
GDRIRVLDX

SEQ ID NO: 678 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 679 - protein, 10 aa, Artificial Sequence
  Description of Artificial Sequence: Synthetic peptide
  MOD_RES (9)..(10): Any amino acid
GHRIRVPDXX

SEQ ID NO: 680 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLQEVGKELQKHFPNKTIKYERSAGGDMEIATHSFNCGGEFFYCNTSNLFNGTYNGTYISTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 681 - protein, 9 aa, Artificial Sequence
  Description of Artificial Sequence: Synthetic peptide
  MOD_RES (9)..(9): Any amino acid
GHRIQDPDX

SEQ ID NO: 682 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSNSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYMLLEDSQHQQERNEKDLLALDSWNSLWNWFNITNWLWYIR

SEQ ID NO: 683 - protein, 9 aa, Artificial Sequence
  Description of Artificial Sequence: Synthetic peptide
  MOD_RES (9)..(9): Any amino acid
GHRIQVPDX

SEQ ID NO: 684 - protein, 690 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNASWSNKSEKDIWDNMTWMQWEREISNYTETIYMLLEDSQHQQERNEKDLLALDSWNSLWNWFNITNWLWYIR

SEQ ID NO: 685 - protein, 9 aa, Artificial Sequence
  Description of Artificial Sequence: Synthetic peptide
  MOD_RES (9)..(9): Any amino acid
GHRIRDLDX

SEQ ID NO: 686 - protein, 686 aa, Artificial Sequence
  Description of Artificial Sequence: Synthetic polypeptide
MKVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNKTLQEVGKELQKHFPNKTIKYERSAGGDMEIATHSFNCGGEFFYCNTSNLFNGTYNGTYISTNSTSSITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTDVPWNTSWSNKSEKDIWDNMTWMQWEREISNYTETIYMLLEDSQHQQERNEKDLLALDSWNSLWNWFNITNWLWYIR

SEQ ID NO: 687 - protein, 9 aa, Artificial Sequence
  Description of Artificial Sequence: Synthetic peptide
  MOD_RES (9)..(9): Any amino acid
GHRIRVLDX

SEQ ID NO: 688 - protein, 686 aa, Artificial Sequence
  Description of Artificial Sequence: Synthetic polypeptide
MRVMGILKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNATVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNNSWSNKSEKDIWDNMTWMQWEREISNYTETIYMLLEDSQHQQERNEKDLLALDSWNSLWNWFNITNWLWYIK

SEQ ID NO: 689 - protein, 10 aa, Artificial Sequence
  Description of Artificial Sequence: Synthetic peptide
  MOD_RES (9)..(10): Any amino acid
GNRIRVPDXX

SEQ ID NO: 690 - protein, 686 aa, Artificial Sequence
  Description of Artificial Sequence: Synthetic polypeptide
MRVMGIPKNYPQWWIWGILGFWMLMICNGKGNLWVTVYYGVPVWKEAKTTLFCASDAKAYEKEVHNVWATHACVPTDPSPQELVLENVTENFNMWKNDMVDQMHEDIISLWDQSLKPCVKLTPLCVTLNCSNAIVDSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLQEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGARERVVEREKEAAGLGALFLGFLGAAGSTMGAASITLTVQARQLLSGIVQQQSNLLRAIEAQQHMLQLTIWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIR

SEQ ID NO: 691 - protein, 9 aa, Artificial Sequence
  Description of Artificial Sequence: Synthetic peptide
  MOD_RES (9)..(9): Any amino acid
GNRIQDPDX

SEQ ID NO: 692 - protein, 686 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRPDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEWQWNKTLHEVGKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNSSWSNKSEKDIWDNMTWMQWEREISNYTETIYKLLEDSQHQQERNEQDLLALDSWNSLWNWFNITNWLWYIK

SEQ ID NO: 693 - protein, 9 aa, Artificial Sequence
  Description of Artificial Sequence: Synthetic peptide
  MOD_RES (9)..(9): Any amino acid
GNRIQVPDX

SEQ ID NO: 694 - protein, 686 aa, Artificial Sequence
  Description of Artificial Sequence: Synthetic polypeptide
MRVMGIPKNYPQWWIWGILGFWILMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCNSATVDNSKVYDTRSNVNVTSINNTIMGEMKNCSFNTTTEIRDKEKKEYALFYKPDVVPLDETSNTSEYRLINCNTSAVTQACPKVTFEPIPIHYCAPAGYAILKCNDKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIK

SEQ ID NO: 695 - protein, 9 aa, Artificial Sequence
  Description of Artificial Sequence: Synthetic peptide
  MOD_RES (9)..(9): Any amino acid
GNRIRDLDX

SEQ ID NO: 696 - protein, 690 aa, Artificial Sequence
  Description of Artificial Sequence: Synthetic polypeptide
MRVRGILKNYPQWWIWGILGFWMLMICNGKGKLWVTVYYGVPVWKEAKTTLFCASDAKAYEKEVHNVWATHACVPTDPSPQELVLENVIENFNMWKNDMVDQMHEDIISLWDQSLKPCVKLTPLCVTLNCSNATVNSSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISERQWNKTLQEVGKELQKHFPNKTIKYERSAGGDMEIATHSFNCGGEFFYCNTSNLFNGTYNGTYISTNSSTNSTSNITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNASWSNKSEKDIWDNMTWMQWEREISNYTETIYMLLEDSQRQQERNEKDLLALDSWNSLWNWFNITNWLWYIR

SEQ ID NO: 697 - protein, 9 aa, Artificial Sequence
  Description of Artificial Sequence: Synthetic peptide
  MOD_RES (9)..(9): Any amino acid
GNRIRVLDX

SEQ ID NO: 698 - protein, 686 aa, Artificial Sequence
  Description of Artificial Sequence: Synthetic polypeptide
MRVMGILKNYLQWWIWGILGFWMLMICKGKGNLWVTVYYGVPVWKEAKTTLFCASDAKAYEKEVHNVWATHACVPTDPSPQELVLENVIENFNMWKNDMVDQMHEDIISLWDQSLKPCVKLTPLCVTLTCSNATVDNSKVYDTRSNVNVTSINNTIMGEMKNCSFNTTTEIRDKEKKEYALFYRSDVVPLDETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISERQWYKTLQEVGKELQKHFPNKTIKYERSAGGDMEIATHSFNCGGEFFYCNTSNLFNGTYNGTYISINSTSYITLQCRIKQIINMWQGVGRAMYAPPIAGNITCKSNITGLLLTRDGGTKNNSNETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNTSWSNKSEKDIWDNMTWMQWEREISNYTETIYTLLEDSQHQQERNEKDLLALDSWNSLWNWFNITNWLWYIK

SEQ ID NO: 699 - protein, 10 aa, Artificial Sequence
  Description of Artificial Sequence: Synthetic peptide
  MOD_RES (9)..(10): Any amino acid
GYRIRVPDXX

SEQ ID NO: 700 - protein, 676 aa, Artificial Sequence
  Description of Artificial Sequence: Synthetic polypeptide
MKVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEGQWNKTLQEVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIK

SEQ ID NO: 701 - protein, 9 aa, Artificial Sequence
  Description of Artificial Sequence: Synthetic peptide
  MOD_RES (9)..(9): Any amino acid
GYRIQDPDX

SEQ ID NO: 702 - protein, 674 aa, Artificial Sequence
  Description of Artificial Sequence: Synthetic polypeptide
MRVMGIPKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEGQWNKTLHEVSKELQKHFPNKTIKYERSAGGDMEIATHSFNCGGEFFYCNTSNLFNGTYNGTYINTSSTSYITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNTSWSNKSEKDIWDNMTWMQWEREISNYTETIYTLLEDSQRQQERNEKDLLALDSWNSLWNWFNITNWLWYIK

SEQ ID NO: 703 - protein, 9 aa, Artificial Sequence
  Description of Artificial Sequence: Synthetic peptide
  MOD_RES (9)..(9): Any amino acid
GYRIQVPDX

SEQ ID NO: 704 - protein, 676 aa, Artificial Sequence
  Description of Artificial Sequence: Synthetic polypeptide
MRVMGILKNYPQWWIWGILGFWMLMNCNGKGNLWVTVYYGVPVWKEAKTTLFCASDAKAYKKEVHNVWATHACVPTDPSPQELVLENVTENFNMWKNDMVDQMHEDIISLWDQSLKPCVKLTPLCVTLNCSNARSNVNVTSINNTIMGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIK

SEQ ID NO: 705 - protein, 9 aa, Artificial Sequence
  Description of Artificial Sequence: Synthetic peptide
  MOD_RES (9)..(9): Any amino acid
GYRIRDLDX

SEQ ID NO: 706 - protein, 674 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLNCSNARSNVNVTSINNTIMGEMKNCSFNTTTEIRDKEKKEYALFYKPDVVPLNETSNTSEYRLINCNTSAVTQACPKVTFEPIPIHYCAPAGYAILKCNNKTFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQEVGKELQKHFPNKTIKYERSAGGDMEIATHSFNCGGEFFYCNTSNLFNGTYNGTDISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTTVPWNASWSNKSEKDIWDNMTWMQWEREISNYTETIYMLLEDSQRQQERNEKDLLALDSWNSLWNWFNITNWLWYIK

SEQ ID NO: 707 - protein, 9 aa, Artificial Sequence
  Description of Artificial Sequence: Synthetic peptide
  MOD_RES (9)..(9): Any amino acid
GYRIRVLDX

SEQ ID NO: 708 - protein, 673 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLDNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSKLFNGTYNGTYISTNSTSYITLQCRIKQIINMWQGVGRAMYAPPIAGNITCKSNITGLLLTRDGGTNNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIK

SEQ ID NO: 709 - protein, 5 aa, Artificial Sequence
  Description of Artificial Sequence: Synthetic peptide
GTRIR

SEQ ID NO: 710 - protein, 675 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQEVGKELQKHFPNKTIKYERSAGGDMEITTHSFNCGGEFFYCNTSNLFNGTYNGPYINISTNSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIK

SEQ ID NO: 711 - protein, 10 aa, Artificial Sequence
  Description of Artificial Sequence: Synthetic peptide
  MOD_RES (9)..(10): Any amino acid
GTRIRSPDXX

SEQ ID NO: 712 - protein, 675 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLKNVTENFNMWKNDMVDQMHEDIISLWDQSLKPCVKLTPLCVTLDCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSNLFNGTYNGTYINISTNSNSTITLQCRIKQIINMWQGVGRAMYAPPIAGNITCRSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWNSSWSNKSEKDIWDNMTWMQWEREISNYTETIYTLLEDSQRQQERNEKDLLALDSWNSLWNWFNITKWLWYIK

SEQ ID NO: 713 - protein, 5 aa, Artificial Sequence
  Description of Artificial Sequence: Synthetic peptide
GTRIR

SEQ ID NO: 714 - protein, 672 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLNCSNVSNVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLQQVGKELQKHFPNKTIKYERSAGGDMEIATHSFNCGGEFFYCNTSNLFNGTYNGTYSTNSTSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICNTAVAWNTSWSNKSEKDIWDNMTWMQWEREISNYTETIYTLLEDSQRQQERNEKDLLALDSWNSLWNWFNITNWLWYIK

SEQ ID NO: 715 - protein, 9 aa, Artificial Sequence
  Description of Artificial Sequence: Synthetic peptide
  MOD_RES (9)..(9): Any amino acid
GTRIRLPDX

SEQ ID NO: 716 - protein, 677 aa, Artificial Sequence
  Description of Artificial Sequence: Synthetic polypeptide
MRVMGILKNYPPWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLNCSNVNVVNVTNITNTIKGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEEKWNKTLHEVSKELQKHFPNKTIKYERSAGGDMEIATHSFNCGGEFFYCNTSNLFNGTYNGTYISTNSSANSNSTITLQCRIKQIINMWQGVGRAMYAPPIAGNITCKSNITGLLLTRDGGTKNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYTLLEDSQRQQERNEKDLLALDSWNSLWNWFNITNWLWYIK

SEQ ID NO: 717 - protein, 5 aa, Artificial Sequence
  Description of Artificial Sequence: Synthetic peptide
GSRIR

SEQ ID NO: 718 - protein, 686 aa, Artificial Sequence
  Description of Artificial Sequence: Synthetic polypeptide
MKVMGILKNYPQWWIWGILGFWMLMICKGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTAYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISEKQWNETLQKVGKELQKHFPNKTIKYERSAGGDMEIATHSFNCGGEFFYCNTSKLFNGTYNGTDINISTNSNSTITLQCRIKQIINMWQGVGRAMYAPPIAGNITCKSNITGLLLTRDGGTNSNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 719 - protein, 9 aa, Artificial Sequence
  Description of Artificial Sequence: Synthetic peptide
EDPNSVTGS

SEQ ID NO: 720 - protein, 677 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTGSNVNVTNITNTITGEMKNCSFNTTTEIRDKEKKEYALFYKPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGGIIGDIRQAHCNISESKWNETLHEVSKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIK

SEQ ID NO: 721 - protein, 9 aa, Artificial Sequence
  Description of Artificial Sequence: Synthetic peptide
EVPNSVTGS

SEQ ID NO: 722 - protein, 677 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCSNVNVVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGKYINISTNSNSTITLQCRIKQIINMWQGVGRAMYAPPIAGNITCKSNITGLLLTRDGGTKNNSTETEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTDVPWNTSWSNKSEKDIWDNMTWMQWEREISNYTETIYTLLEDSQRQQERNEKDLLALDSWNSLWNWFNITNWLWYIK

SEQ ID NO: 723 - protein, 686 aa, Artificial Sequence
  Description of Artificial Sequence: Synthetic polypeptide
MRVMGILKNCPQWWIWGILGFWMLMICNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYDTRSNVSVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPSNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYTNISTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIK

SEQ ID NO: 724 - protein, 669 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLNCVNVTNITNTIKGEMKNCSFNTTTEIRDKEKKEYALFYRPDVVPLNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPGNNTRKSVRIGPGQTFYATGDIIGDIRQAHCNISEEKWNKTLQQVGKELQKHFPNKTIKYERSAGGDMEITTHSFNCGGEFFYCNTSNLFNGTYNGTYNGSTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYTLLEDSQRQQERNEKDLLALDSWNSLWNWFNITNWLWYIK

SEQ ID NO: 725 - protein, 9 aa, Artificial Sequence
  Description of Artificial Sequence: Synthetic peptide
  MOD_RES (9)..(9): Any amino acid
GSRIRSPDX

SEQ ID NO: 726 - protein, 684 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELFLENVTENFNMWKNDMVDQMHEDIISLWDQSLKPCVKLTPLCVTLICSNATVNNRTVYDTRSNANVTSINNTIMGEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSNLFNGTYNGTYNGTNSNSTITLQCRIKQIINMWQGVGRAMYAPPIAGNITCRSNITGLLLTRDGGTNSNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTTVAWNTSWSNKSEKDIWDNMTWMQWEREISNYTETIYTLLEDSQRQQERNEKDLLALDSWNSLWNWFNITNWLWYIK

SEQ ID NO: 727 - protein, 9 aa, Artificial Sequence
  Description of Artificial Sequence: Synthetic peptide
EDPNSVTGS

SEQ ID NO: 728 - protein, 684 aa, Artificial Sequence
  Description of Artificial Sequence: Synthetic polypeptide
MRVMGIPKNYPQWWIWGILGFWMLMICSGRGNLWVTVYYGVPVWKEAKTTLFCASDAKAYEKEMHNVWATHACVPTDPSPQELFLENVTENFNMWKNDMVDQMHEDIISLWDQSLKPCVKLTPLCVTLICSNATVNNRTVYDTRSNVNVTSINNTIMGEMKNCSFNTTTEIRDKEKKEYALFYKPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGDIIGDIRQAHCNISEEKWNKTLQKVGKELQKHFPNKTIKYERSAGGDMEITTHSFNCGGEFFYCNTSKLFNGTYNGINISTNSNSTITLQCRIKQIINMWQGVGRAMYAPPIAGNITCKSNITGLLLTRDGGNRNNSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 729 - protein, 9 aa, Artificial Sequence
  Description of Artificial Sequence: Synthetic peptide
EVPNSVTGS

SEQ ID NO: 730 - protein, 668 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNDMVDQMHEDIISLWDQSLKPCVKLTPLCVTLICSNATVNNRTVYEMKNCSFNTTTEIRDKEKKEYALFYRPDIVPLGETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTVVPWNTSWSNKSEKDIWDNMTWMQWEREISNYTETIYKLLEDSQNQQERNEQDLLALDSWNSLWNWFNITKWLWYIK

SEQ ID NO: 731 - protein, 6 aa, Artificial Sequence
  Description of Artificial Sequence: Synthetic peptide
  MOD_RES (6)..(6): Any amino acid
IRSPDX

SEQ ID NO: 732 - protein, 668 aa, Artificial Sequence
  Description of Artificial Sequence: Synthetic polypeptide
MRVMGIPKNYPQWWIWGILGFWMLMNCNGKGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPGNNTRKSVRIGPGQTFYATGAIIGDIRQAHCNISESKWNETLQKVGKELQKHFPNKTIKYEQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 733 - protein, 6 aa, Artificial Sequence
  Description of Artificial Sequence: Synthetic peptide
  MOD_RES (6)..(6): Any amino acid
IRSPDX

SEQ ID NO: 734 - protein, 669 aa, Artificial Sequence
  Description of Artificial Sequence: Synthetic polypeptide
MKVMGIPKNYPQWWIWGILGFWMLMNCNGKENLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEKQWNETLQKVGKELQKHFPNKTIKYERSAGGDMEITTHSFNCGGEFFYCNTSKLFNGTYNGTDISTNSSANSNSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYKLLEDSQNQQERNEQDLLALDSWNSLWNWFNITKWLWYIK

SEQ ID NO: 735 - protein, 5 aa, Artificial Sequence
  Description of Artificial Sequence: Synthetic peptide
GSRIR

SEQ ID NO: 736 - protein, 668 aa, Artificial Sequence
  Description of Artificial Sequence: Synthetic polypeptide
MRVMGILKNCPQWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSNATVNNRTVYEMKNCSFNTTTEIRDKEKKEYALFYRPDIVPLNETSNTSEYRLINCNTSAVTQACPKVTFEPIPIHYCAPAGYAILKCNNKTFNGTGPCSKVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSKLFNGTYNGAYINISTNSNSTITLQCRIKQIINMWQGVGRAMYAPPIAGNITCKSNITGLLLTRDGGTNNKTEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 737 - protein, 9 aa, Artificial Sequence
  Description of Artificial Sequence: Synthetic peptide
EDPNSVTGS

SEQ ID NO: 738 - protein, 669 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDAKAYKKEVHNVWATHACVPTDPSPQELVLKNVTENFNMWKNNRVDQMHEDIISLWDQSLKPCVKLTPLCVTLICSNATVDNRTVGEMKNCSFNTTTEIRDKEKKEYALFYKPDVVPLDETNNTSEYRLINCNTSAVTQACPKVTFEPIPIHYCAPAGYAILKCNNETFNRTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIK

SEQ ID NO: 739 - protein, 9 aa, Artificial Sequence
  Description of Artificial Sequence: Synthetic peptide
EVPNSVTGS

SEQ ID NO: 740 - protein, 686 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLQKVGKELQKHFPNKTIKYERPAGGDLEITTHSFNCGGEFFYCNTSKLFNGTYNGTDISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIK

SEQ ID NO: 741 - protein, 690 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGKELQKHFPNKTIKYAQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVPWDSSWSNKSEKDIWDNMTWMQWEREISNYTETIYKLLEDSQNQQERNEQDLLALDSWNSLWNWFNITNWLWYIK

SEQ ID NO: 742 - protein, 671 aa, Artificial Sequence
  Description of Artificial Sequence: Synthetic polypeptide
MRVMGILKNYPQWWIWGILGFWMLMICKGKGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSNATVNNRTVYEMKNCSFNTTTEIRDKEKKEYALFYRSDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGEIRQAHCNISESKWNETLQKVGKELQKHFPNKTIKYERSAGGDMEITTHSFNCGGEFFYCNTSKLFNGTYNGTDISTNSSANSNSTITLQCRIKQIINIWQGVGRAMYAPPIAGNITCKSNITGLLLTRDGGNNNNRNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 743 - protein, 10 aa, Artificial Sequence
  Description of Artificial Sequence: Synthetic peptide
  MOD_RES (9)..(10): Any amino acid
GSRIRLPDXX

SEQ ID NO: 744 - protein, 672 aa, Artificial Sequence
  Description of Artificial Sequence: Synthetic polypeptide
MRVMGIPKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVDNRTVGEMKNCSFNTTTEIRDKEKKEYALFYRPDIVPLSETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGEIKQAHCNISEEKWNETLQKVGKELQKHFPNKIIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGTNSSKTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIK

SEQ ID NO: 745 - protein, 9 aa, Artificial Sequence
  Description of Artificial Sequence: Synthetic peptide
EDPNSVTGS

SEQ ID NO: 746 - protein, 671 aa, Artificial Sequence
  Description of Artificial Sequence: Synthetic polypeptide
MRVMGILKNYPQWWIWGILGFWMLMICNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTSNLFNGTYNGTYMNISTDSNSTITLQCRIKQIINMWQGVGRAMYAPPIAGNITCRSNITGLLLTRDGGTNSSKTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIK

SEQ ID NO: 747 - protein, 9 aa, Artificial Sequence
  Description of Artificial Sequence: Synthetic peptide
EVPNSVTGS

SEQ ID NO: 748 - protein, 672 aa, Artificial Sequence
  Description of Artificial Sequence: Synthetic polypeptide
MRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYEQSAGGDMEITTHSFNCGGEFFYCTTSKLFNGTYNGTDISTNSSANSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 749 - protein, 6 aa, Artificial Sequence
  Description of Artificial Sequence: Synthetic peptide
  MOD_RES (6)..(6): Any amino acid
IRLPDX

SEQ ID NO: 750 - protein, 674 aa, Artificial Sequence
  Description of Artificial Sequence: Synthetic polypeptide
MRVTGILKNYPQWWIWGILGFWMLMNCNGKENLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTVDEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNNSSKTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIK

SEQ ID NO: 751 - protein, 6 aa, Artificial Sequence
  Description of Artificial Sequence: Synthetic peptide
  MOD_RES (6)..(6): Any amino acid
IRLPDX

SEQ ID NO: 752 - protein, 672 aa, Artificial Sequence
  Description of Artificial Sequence: Synthetic polypeptide
MRVMGIPKNCPQWWIWGILGFWMLMICNGKGKLWVTIYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNDTLQKVGKELQKHFPNKTIEYKQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEEEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 753 - protein, 9 aa, Artificial Sequence
  Description of Artificial Sequence: Synthetic peptide
  MOD_RES (9)..(9): Any amino acid
EFGDRDPDX

SEQ ID NO: 754 - protein, 671 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDTRQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 755 - protein, 9 aa, Artificial Sequence
  Description of Artificial Sequence: Synthetic peptide
  MOD_RES (9)..(9): Any amino acid
EFGHRDPDX

SEQ ID NO: 756 - protein, 670 aa, Artificial Sequence
  Description of Artificial Sequence: Synthetic polypeptide
MRVTGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSHATVENSTTEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIIGEIRQAHCNISKETWNDTLQKVGKELQKHFPNKTIRYNQSAGGDMEITTHSFNCGGEFFYCNTAKLFNSTYNGTYISTNSTNSTSYITLQCRIKQIINMWQGVGRAMYAPPIAGNITCRSNITGLLLTRDGGTNSSEEEIFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 757 - protein, 10 aa, Artificial Sequence
  Description of Artificial Sequence: Synthetic peptide
  MOD_RES (9)..(10): Any amino acid
EFGNRDPDXX

SEQ ID NO: 758 - protein, 672 aa, Artificial Sequence
  Description of Artificial Sequence: Synthetic polypeptide
MRVTGILKNYPQWWIWGILGFWMLMICNGEENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLMCSNAIVKNSTTEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPNNNTRKSVRIGPGQTFYATGDIIGDPRQAHCNISEKKWNETLQKVGIELQKHFPNKTIKYNQSAGGDMEITTHSFNCGGEFFYCNTAKLFNSTYNGTYISTNSTDSTSNITLQCRIKQIINMWQGVGRAMYAPPIAGNITCRSNITGLLLTRDGGINNDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 759 - protein, 9 aa, Artificial Sequence
  Description of Artificial Sequence: Synthetic peptide
  MOD_RES (9)..(9): Any amino acid
EFGYRDPDX

SEQ ID NO: 760 - protein, 673 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSTATVNKSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGGIVGDIRQAHCNISKGLWNDTLQKVGIELQKHFPNKTIKYNQSAGGDMEITTHSFNCGGEFFYCNTSNLFNGTYNGTYISTNSSANSTSYITLQCRIKQIINMWQGVGRAMYAPPIAGNITCRSNITGLLLTRDGGTTNNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 761 - protein, 9 aa, Artificial Sequence
  Description of Artificial Sequence: Synthetic peptide
  MOD_RES (9)..(9): Any amino acid
EFGDRVPDX

SEQ ID NO: 762 - protein, 672 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNAIVENGTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGDPRQAHCNISKEKWNDTLQKVGKELQKHFPNKTIRYNQSAGGDMEITTHSFNCGGEFFYCNTAKLFNSTYNGTYISTNSTNSTSNITLQCRIKQIINMWQGVGRAMYAPPIAGNITCRSNITGLLLTRDGGTTNNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFNITKWLWYIK

SEQ ID NO: 763 - protein, 9 aa, Artificial Sequence
  Description of Artificial Sequence: Synthetic peptide
  MOD_RES (9)..(9): Any amino acid
EFGDQDPDX

SEQ ID NO: 764 - protein, 672 aa, Artificial Sequence
  Description of Artificial Sequence: Synthetic polypeptide
MRVMGIQKNYPRWWIWGILGFWMLMICNGEGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNSTTEEMKNCSFNTTTEIRDKEKKEHALFYRPDIVPLNNETGNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSKLFNSTYNGTYISTNSTNSTSYITLQCRIKQIINMWQGVGRAMYAPPIAGNITCRSNITGLLLTRDGGINNDSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTGTIYKLLEDSQNQQERNEQDLLALDSWNSLWNWFNITKWLWYIK

SEQ ID NO: 765 - protein, 9 aa, Artificial Sequence
  Description of Artificial Sequence: Synthetic peptide
  MOD_RES (9)..(9): Any amino acid
EFGDQVPDX

SEQ ID NO: 766 - protein, 671 aa, Artificial Sequence
  Description of Artificial Sequence: Synthetic polypeptide
MRVTGILKNYPRWWIWGILGFWMLMICNGKGKLWVTVYYGVPVWKEAKTTLFCASDARAYEKEVHNVWATHACVPTDPSPQELVLDNVTENFNMWKNDMVDQMHEDIISLWDQSLKPCVKLTPLCVTLICSIATANGSTVEEMKNCSFNTTTEIRDKEKKEYALFYRPDIVPLNNKTSNISEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIRYNQSAGGDMEITTHSFNCGGEFFYCNTSNLFNSTYNDTYISTNSSANNSSTITLQCRIKQIINMWQGVGRAMYAPPIAGNITCKSNITGLLLTRDGGTDSNETETFRPAGGDMRDNWRSELYKYKVVEIQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNNLWSWFSITKWLWYIK

SEQ ID NO: 767 - protein, 9 aa, Artificial Sequence
  Description of Artificial Sequence: Synthetic peptide
  MOD_RES (9)..(9): Any amino acid
EFGDRDLDX

SEQ ID NO: 768 - protein, 673 aa, Artificial Sequence
  Description of Artificial Sequence: Synthetic polypeptide
MRVTGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLICSNATVENSTTEEMKNCSFNTTTEIRDKEKKEHALFYRPDIVPLNNETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPNNNTRKSVRIGPGQTFYATGDIIGNIRQAHCNISESKWNDTLQKVGIELQKHFPNKTIKYNQSAGGDMEITTHSFNCGGEFFYCNTAKLFNSTYNGTYISTNSTNSTSKNITLQCRIKQIINMWQGVGRAMYAPPIAGNITCRSNITGLLLTRDGGTTNNSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 769 - protein, 9 aa, Artificial Sequence
  Description of Artificial Sequence: Synthetic peptide
  MOD_RES (9)..(9): Any amino acid
EFGDRVLDX

SEQ ID NO: 770 - protein, 672 aa, Artificial Sequence
  Description of Artificial Sequence: Synthetic polypeptide
MRVTGILKNYPQWWIWGILGFWMLMTCNGEGNLWVTVYYGVPVWKEAKTTLFCASDAKAYKKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESEWNETLQKVGKELQKHFPNKTIKYEQSAGGDMEITTHSFNCGGEFFYCNTAELFNGTYNGTDISTNSSANSTSTITLQCRIKQIINMWQGVGRAMYAPPIAGNITCRSNITGLLLTRDGGINNVSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIK

SEQ ID NO: 771 - protein, 9 aa, Artificial Sequence
  Description of Artificial Sequence: Synthetic peptide
  MOD_RES (9)..(9): Any amino acid
EFGHRVPDX

SEQ ID NO: 772 - protein, 672 aa, Artificial Sequence
  Description of Artificial Sequence: Synthetic polypeptide
MRVTGIRKNCPQWWIWGILGFWMLMNCNGEGNLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLICSTATVNNSKFEEMKNCSFNTTTEIRDKEKKEYALFYRPDIVPLDNETSNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGNPRQAHCNISKERWNDTLQKVGKELQKHFPNKTIKYNQSAGGDMEITTHSFNCGGEFFYCNTSNLFNSTYNDTYISTNSTNSTSYITLQCRIKQIINMWQGVGRAMYAPPIAGNITCKSNITGLLLTRDGGINKDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIK

SEQ ID NO: 773 - protein, 9 aa, Artificial Sequence
  Description of Artificial Sequence: Synthetic peptide
  MOD_RES (9)..(9): Any amino acid
EFGHQDPDX

SEQ ID NO: 774 - protein, 697 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSKVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGINNVSNETETFRPAGGDMRDNWRSELYKYKVVEVQPLGLAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIK

SEQ ID NO: 775 - protein, 9 aa, Artificial Sequence
  Description of Artificial Sequence: Synthetic peptide
  MOD_RES (9)..(9): Any amino acid
EFGHQVPDX

SEQ ID NO: 776 - protein, 691 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNNTTDYDSRSNANVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSKVSTVQCTHGIRPVVSTQLLLNGSLAEKGIVIRSENLTNNAKIIIVQLNTSVEIVCTRPGNNTRKSMRIGPGQTFYATGDIIGDIRQAHCNISESKWNDTLQKVGIELQKHFPNKTIKYNQSAGGDMEITTHSFNCGGEFFYCNTAKLFNSTYNGTYISTNSSANSTSKNITLQCRIKQIINMWQGVGRAMYAPPIAGNITCRSNITGLLLTRDGGIHNDSNETETFRPAGGDMRDNWRSELYKYKVVEIQPLGIAPTGAKERVVGREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWNWFSITKWLWYIK

SEQ ID NO: 777 - protein, 9 aa, Artificial Sequence
  Description of Artificial Sequence: Synthetic peptide
  MOD_RES (9)..(9): Any amino acid
EFGHRDLDX

SEQ ID NO: 778 - protein, 684 aa, Artificial Sequence
  Description of Artificial Sequence: Synthetic polypeptide
MRVTGILRNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSTALVKNSTTEAMKNCSFNTTTEIRDKEKKEYALFYRPDIVPLNNETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVHLHTPVEIVCTRPNNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSSANNSSTITLQCRIKQIINMWQGVGRAMYAPPIAGNITCKSNITGLLLTRDGGPDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQNLLALDSWNSLWNWFSITKWLWYIK

SEQ ID NO: 779 - protein, 9 aa, Artificial Sequence
  Description of Artificial Sequence: Synthetic peptide
  MOD_RES (9)..(9): Any amino acid
EFGHRVLDX

SEQ ID NO: 780 - protein, 672 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPGHNTRKSVRIGPGQTFYATGDIIGDIRQAHCNINESKWNETLQKVGNELQKHFPNKTIKYEQAAGGDMEITTHSFNCGGEFFYCNTANLFNGTYNGTDISTNSSANSTSTITLQCKIKQIINMWQGVGRAMYAPPIAGNITCRSNITGLLLTRDGGINNVSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIK

SEQ ID NO: 781 - protein, 10 aa, Artificial Sequence
  Description of Artificial Sequence: Synthetic peptide
  MOD_RES (9)..(10): Any amino acid
EFGNRVPDXX

SEQ ID NO: 782 - protein, 682 aa, Artificial Sequence
  Description of Artificial Sequence: Synthetic polypeptide
MRVTGILKNYPRWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTAKLFNSTYNDTYKSTNSSANNSSIITLQCRIKQIINMWQGVGRAMYAPPIAGNITCKSNITGLLLTRDGGINNVSNETETFRPAGGDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQDLLALDSWNSLWNWFSITKWLWYIK

SEQ ID NO: 783 - protein, 9 aa, Artificial Sequence
  Description of Artificial Sequence: Synthetic peptide
  MOD_RES (9)..(9): Any amino acid
EFGNQDPDX

SEQ ID NO: 784 - protein, 691 aa, Artificial Sequence
  Description of Artificial Sequence: Synthetic polypeptide
MRVTGILKNYPRWWIWGILGFWMLMNCNGEGKLWVTVYYGVPVWKEAKTTLFCASDAKAYVKEVHNVWATHACVPTDPSPQELFLKNVTENFNMWKNDMVDQMHEDIISLWDQSLKPCVKLTPLCVTLNCSNATVNSTTDYDSRSNDTVTNITNTIKEEVKNCSFKTTTEIRDKEKKEHALFYRPDIVPLNSETGNTSEYRLINCNTSAVTQACPKVTFEPIPIHYCAPAGYAILKCNDETFNGTGPCSNVSTVQCTHGIRPVVSTQLLLNGSLAKEEIVIRSENLTNNAKTIIVHLHTPVEIVCTRPGNNTRKSMRIGPGQTFYATGDIIGDIRQAHCNISEEKWNKTLQEVGKELQKHFPNRTIKYNQSAGGDMEITTHSFNCGGEFFYCNTSKLFNSTYNDTYISTNSTNSSANNSSIITLQCRIKQIINMWQGVGRAMYAPPIAGNIICKSNITGLLLTRDGGPDSNKTETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 785 - protein, 9 aa, Artificial Sequence
  Description of Artificial Sequence: Synthetic peptide
  MOD_RES (9)..(9): Any amino acid
EFGNQVPDX

SEQ ID NO: 786 - protein, 689 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPNPQEMFLKNVTENFNMWKNDMVDQMHEDIISLWDQSLKPCVKLTPLCVTLNCSNATVNSTTDYDSRSNDSVTNITNTIKEEVKNCSFKTTTEIRDKEKKEHALFYRPDIVPLNSETGNISEYRLINCNTSAVTQACPKVTFEPIPIHYCAPAGYAILKCNDETFNGTGPCSNVSTVQCTHGIRPVVSTQLLLNGSLAKEEIVIRSENLTNNAKIIIVQLNTSVEIVCTRPGNNTRKSVRIGPGQTFYATGDIIGDIRQAHCNISEKKWNETLQRVGIELQKHFPNKTIKYNQSAGGDMEITTHSFNCGGEFFYCNTAKLFNSTYNGTYINTTSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 787 - protein, 9 aa, Artificial Sequence
  Description of Artificial Sequence: Synthetic peptide
  MOD_RES (9)..(9): Any amino acid
EFGNRDLDX

SEQ ID NO: 788 - protein, 672 aa, Artificial Sequence
  Description of Artificial Sequence: Synthetic polypeptide
MRVTGILKNYPQWWIWGILGFWMLMNCNGEGNLWVTVYYGVPVWKEAKTTLFCASDAKAYEKEVHNVWATHACVPTDPSPQELFLENVTENFNMWKNDMVDQMHEDIISLWDQSLKPCVKLTPLCVTLICSTATVNNSTVDEMKNCSFNATTEIRDKKKKEYALFYRSDVVSLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHAPVEIVCTRPGHNTRKSVRIGPGQTFYATGDIIGNIRQAHCNINESEWNETLQKVGKELRKHFPNKTIKYEQSAGGDMEITTHSFNCGGEFFYCNTANLFNGTYNGTDISTNSSADRNSTITLECKIKQIINMWQGVGRAMYAPPIAGNITCRSNITGLLLTRDGGINNVSNATETFRPAGGDMRDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWNNMTWMQWEREISNYTETIYMLLEDSQRQQERNEKDLLALDSWNSLWNWFNITNWLWYIK

SEQ ID NO: 789 - protein, 9 aa, Artificial Sequence
  Description of Artificial Sequence: Synthetic peptide
  MOD_RES (9)..(9): Any amino acid
EFGNRVLDX

SEQ ID NO: 790 - protein, 679 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 791 - protein, 10 aa, Artificial Sequence
  Description of Artificial Sequence: Synthetic peptide
  MOD_RES (9)..(10): Any amino acid
EFGYRVPDXX

SEQ ID NO: 792 - protein, 685 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHAPVEIVCTRPYNNTRKSVRIGPGQTFYATGDIIGDPRQAHCNISKEIWNKTLQEVGKELQKHFPNKTIRYNQSAGGDMEITTHSFNCGGEFFYCNTSNLFNSTYNDTYISPNSTNSTSIITLQCKIKQIINMWQGVGRAMYAPPIAGNITCKSNITGLLLTRDGGINNVSNETETFRPAGGDMRDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWNNMTWMQWEREISNYTGTIYKLLEDSQNQQERNEKDLLALDSWNSLWSWFNITKWLWYIK

SEQ ID NO: 793 - protein, 9 aa, Artificial Sequence
  Description of Artificial Sequence: Synthetic peptide
  MOD_RES (9)..(9): Any amino acid
EFGYQDPDX

SEQ ID NO: 794 - protein, 687 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWDNMTWMQWEREISNYTGTIYKLLEESQNQQERNEQDLLALDSWNSLWNWFNITKWLWYIK

SEQ ID NO: 795 - protein, 9 aa, Artificial Sequence
  Description of Artificial Sequence: Synthetic peptide
  MOD_RES (9)..(9): Any amino acid
EFGYQVPDX

SEQ ID NO: 796 - protein, 685 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEISNATVKNITIKEMKNCSFNTTTEIRDKIKKERALFYRTDIVPLNKETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRQAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGINNVSNETETFRPAGGDMRDNWRSELYKYKVVEVQPLGIAPTGAKERVVERGKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIK

SEQ ID NO: 797 - protein, 9 aa, Artificial Sequence
  Description of Artificial Sequence: Synthetic peptide
  MOD_RES (9)..(9): Any amino acid
EFGYRDLDX

SEQ ID NO: 798 - protein, 686 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEKMSNVTVNNITIEEMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKTIIVHLHAPVEIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 799 - protein, 9 aa, Artificial Sequence
  Description of Artificial Sequence: Synthetic peptide
  MOD_RES (9)..(9): Any amino acid
EFGYRVLDX

SEQ ID NO: 800 - protein, 687 aa, Artificial Sequence
  Description of Artificial Sequence: Synthetic polypeptide
MRVMGILKNYPRWWIWGILGFWMLMICNGKGKLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEELSNALARNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTTKLFNSTYNGTYISTNSINSTLNITLQCRIKQIINMWQGIGRAMYAPPIAGNITCRSNITGLLLTRDGGIHNDSNETETFRPAGGDMRDNWRSELYKYKVVEIQPLGIAPTGAKERVVERGKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWDNMTWMQWEREISNYTGTIYKLLEDSQNQQERNEQDLLALDSWNSLWNWFDITKWLWYIK

SEQ ID NO: 801 - protein, 9 aa, Artificial Sequence
  Description of Artificial Sequence: Synthetic peptide
  MOD_RES (9)..(9): Any amino acid
GDRDPNSDX

SEQ ID NO: 802 - protein, 676 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVENSTEAMKNCSFNTTTEIRDKIKKERALFYRPDIVPLNNETGNISEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHNPVEIVCTRPYNNTRKSVRIGPGQTFYATGDIIGDPRKAHCNISKEEWNKTLQEVGKELQKHFPNKTIRYNQSAGGDMEITTHSFNCGGEFFYCNTSNLFNSTYNDTYISPNSTNSTSIITLQCRIKQIINMWQGVGRAMYAPPIAGNITCKSNITGLLLTRDGGPESNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 803 - protein, 10 aa, Artificial Sequence
  Description of Artificial Sequence: Synthetic peptide
  MOD_RES (9)..(10): Any amino acid
GHRDPNSDXX

SEQ ID NO: 804 - protein, 679 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSNATVGNSTEAMKNCSFNTTTEIRDKIKKERALFYRPDIVPLNDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNVKIIIVHLHTPVQIVCTRPYNNTRKSVRIGPGQTFYATGDIIGDPRKAHCNISEKDWNKTLQEVGKELQKHFPNKTIRYNQSAGGDMEITTHSFNCGGEFFYCNTSKLFNSTYNDTYISTNSTNSSANNSSIITLQCRIKQIINMWQGVGRAMYAPPIAGNITCKSNITGLLLTRDGGPDNKTETFRPAGGDMRDNWRSELYKYKVVEVQPLGIAPTGAKERVVEREKEAVGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 805 - protein, 10 aa, Artificial Sequence
  Description of Artificial Sequence: Synthetic peptide
  MOD_RES (9)..(10): Any amino acid
GNRDPNSDXX

SEQ ID NO: 806 - protein, 687 aa, Artificial Sequence
  Description of Artificial Sequence: Synthetic polypeptide
MRVTGILKNCPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVRNSTTEKMSDALDRNSTTEEMKNCSFNTTTEIRDKEKKEYALFYRPDIVPLNNKTSNISEYRLINCNTSTVTQACPKVTFEPIPIHYCAPAGYAILKCNNETFNGTGPCSNVSTVQCTHGIRPVVSTQLLLNGSLAKEEIVIRSENLTNNAKIIIVQLNANASVEIVCTRPNNNTRKSVRIGPGQTFYATGDIIGDIRQAHCNISEKKWNETLQQVGIELQKHFPNKTIKYNQSAGGDMEITTHSFNCGGEFFYCNTAKLFNSTYNGTYISTDSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVGREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWDNMTWMQWEREISNYTGTIYKLLEESQNQQERNEQDLLALDSWNSLWSWFNITKWLWYIK

SEQ ID NO: 807 - protein, 9 aa, Artificial Sequence
  Description of Artificial Sequence: Synthetic peptide
  MOD_RES (9)..(9): Any amino acid
GYRDPNSDX

SEQ ID NO: 808 - protein, 681 aa, Artificial Sequence
  Description of Artificial Sequence: Synthetic polypeptide
MRVMGILKNYPQWWIWGILGFWMLMICNGKGNLWVTVYYGVPVWKEAKTTLFCASDARAYEKEVHNVWATHACVPTDPSPQELFLENVTENFNMWKNDMVDQMHEDIISLWDQSLKPCVKLTPLCVTLNCSNVNVTRSNVNVTNITNTIKGEMKNCSFNTTTEIRDKEKKEYALFYRSDVVPLNETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNKTLHEVSKELQKHFPNKTIKYAQSAGGDMEITTHSFNCGGEFFYCNTSNLFNGTYNGTYISTNSSANSNSTITLQCRIKQIINMWQGVGRAMYAPPIAGNITCRSNITGLLLTRDGGTKNNKTEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYMLLEDSQRQQERNEKDLLALDSWNSLWNWFNITNWLWYIK

SEQ ID NO: 809 - protein, 669 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVNNRTMGEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGGIIGDIRQAHCNISEGQWNETLQKVGKELQKHFPNKTIKYEQSAGGDMEITTHSFNCGGEFFYCNTSKLFNGTYNGTYISTNSSTNSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEQDLLALDSWNSLWNWFNITKWLWYIK

SEQ ID NO: 810 - protein, 688 aa, Artificial Sequence
  Description of Artificial Sequence: Synthetic polypeptide
MRVMGILKNYPQWWIWGILGFWMLMNCNGKENLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVNNRTDYDTRSNVNVTNITNTIKGEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNTSVEIVCTRPGNNTRKSVRIGPGQTFYATGDIIGDIRQAHCNISESKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNSSEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEKDIWDNMTWMQWEREISNYTETIYKLLEDSQNQQERNEQDLLALDSWNSLWNWFNITKWLWYIK

SEQ ID NO: 811 - protein, 690 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYKKEVHNVWATHACVPTDPSPQELVLGNVTENFNMWKNDMVDQMHEDIISLWDQSLKPCVKLTPLCVTLICSNATVNNRTVYDSRSNDNVTSINNTIMGEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPGNNTRKSVRIGPGQTFYATGDIIGDIRQAHCNISEEKWNETLQKVGIELQKHFPNKTIKYEQSAGGDMEITTHSFNCGGEFFYCNTSNLFNGTYNGTYISTNSSANSTSTITLQCRIKQIINMWQGVGRAMYAPPIAGNITCKSNITGLLLTRDGGTNNTSNEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTAVAWNTSWSNKSEKDIWDNMTWMQWEREISNYTETIYKLLEDSQNQQERNEQDLLALDSWNSLWNWFNITKWLWYIK

SEQ ID NO: 812 - protein, 672 aa, Artificial Sequence
  Description of Artificial Sequence: Synthetic polypeptide
MRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVDNRTVGEMKNCSFNTTTEIRDKEKKEYALFYRPDIVPLNNETSNTSEYRLINCNTSAVTQACPKVTFEPIPIHYCAPAGYAILKCNNETFNGTGPCSNVSTVQCTHGIRPVVSTQLLLNGSLAEKGIVIRSENLTNNAKIIIVQLNTSVEIVCTRPNNNTRKSVRIGPGQTFYATGDIIGEIRQAHCNISEEKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 813 - protein, 672 aa, Artificial Sequence
  Description of Artificial Sequence: Synthetic polypeptide
MRVMGILKNYPQWWIWGILGFWMLMICNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNATVKNSTVEEMKNCSFNTTTEIRDKEKKEYALFYRPDIVPLNNETSNTSEYRLINCNTSAVTQACPKVTFEPIPIHYCAPAGYAILKCNDETFNGTGPCSNVSTVQCTHGIRPVVSTQLLLNGSLAEKGIVIRSENLTNNAKIIIVHLHTPVEIVCTRPNNNTRKSVRIGPGQTFYATGDIIGDIRQAHCNISESKWNETLQKVGKELQKHFPNKTIKYAQSAGGDMEITTHSFNCGGEFFYCNTAKLFNGTYNGTDISTNSSTNSNPTITLQCRIKQIINMWQGVGRAMYAPPIAGNITCKSNITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 814 - protein, 673 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSNATVKNRTVYEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKEWNETLQKVGKELQKHFPNKTIKYEQSAGGDMEITTHSFNCGGEFFYCNTSNLFNGTYNGTDISTNSSAKSNSTITLQCRIKQIINMWQGVGRAMYAPPIAGNITCKSNITGLLLTRDGGNSSKTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYMLLEDSQRQQERNEKDLLALDSWNSLWNWFNITKWLWYIK

SEQ ID NO: 815 - protein, 674 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLDNVTENFNMWKNDMVDQMHEDIISLWDQSLKPCVKLTPLCVTLICSTATVDNSTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGEIRQAHCNISEEEWNETLQKVGKELQKHFPNKTIKYEQSAGGDMEITTHSFNCGGEFFYCNTANLFNGTYNGTDISTNSSTKSNSTITLQCRIKQIINMWQGVGRAMYAPPIAGNITCKSNVTGLLLTRDGGTNSSQTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYKLLEDSQNQQERNEQDLLALDSWNSLWNWFNITKWLWYIK

SEQ ID NO: 816 - protein, 669 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLNAPVEIVCTRPNNDTRKSVRIGPGQTFYATGDIIGDIRQAHCNISEKEWNETLQKVGIELQKHFPNKTIKYEQSAGGDMEITTHSFNCGGEFFYCNTSKLFNGTYNGTYINTSSNSTITLQCRIKQIINMWQGVGRAMYAPPIAGNITCKSDITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 817 - protein, 672 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEKEWNETLQKVGKELQKHFPNKTIKYAQSAGGDMEITTHSFNCGGEFFYCNTANLFNGTYNGTDISTNSSTKSNSTITLQCRIKQIINMWQGVGRAMYAPPIAGNITCRSTITGLLLTRDGGNSSKTEEETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSKTDIWDNMTWMQWEREISNYTETIYKLLEDSQNQQERNEQDLLALDSWNSLWNWFNITKWLWYIK

SEQ ID NO: 818 - protein, 672 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYEKEVHNVWATHACVPTDPSPQELVLGNVTENFNMWKNDMVDQMHEDIISLWDQSLKPCVKLTPLCVTLICSNTVNNRTVYEMKNCSFNTTTEIRDKEKKEYALFYRPDIVPLNENETSNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVQLNTSVEIVCTRPNNNTRKSVRIGPGQTFYATGDIIGEIRQAHCNISEEEWNDTLQKVGKELQKHFPNKTIEYKQSAGGDMEITTHSFNCGGEFFYCNTAKLFNGTYNGTDISTNSSTNSNPTITLQCRIKQIINMWQGVGRAMYAPPIAGNITCKSNITGLLLTRDGGNSSKTEEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTGTIYKLLEDSQNQQERNEQELLALDSWNSLWNWFNITKWLWYIK

SEQ ID NO: 819 - protein, 670 aa, Artificial Sequence
  Description of Artificial Sequence: Synthetic polypeptide
MRVMGILKNYPQWWIWGILGFWMLMNCNGEGNLWVTVYYGVPVWKEAKTTLFCASDAKAYKKEVHNVWATHACVPTDPSPQELFLDNVTENFNMWKNDMVDQMHEDIISLWDQSLKPCVKLTPLCVTLICSNATVENKTVEEMKNCSFNTTTEIRDKEKKEYALFYKPDVVPLDETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEKKWNETLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 820 - protein, 670 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELVLGNVTENFNMWKNDMVDQMHEDIISLWDQSLKPCVKLTPLCVTLICSNATVKNGTVEEMKNCSFNTTTEIRDKEKKEYALFYKPDIVPLSETNNTSEYRLINCNTSAVTQACPKVTFEPIPIHYCAPAGYAILKCNDETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIKQAHCNISEEKWNDTLQKVGIELQKHFPNKTIKYNQSAGGDMEITTHSFNCGGEFFYCNTSNLFNGTYNGTYISTNSSANSTSTITLQCRIKQIINMWQGVGRAMYAPPIAGNITCRSNITGLLLTRDGGTNSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFSITKWLWYIK

SEQ ID NO: 821 - protein, 671 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPSPQELFLKNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 822 - protein, 671 aa, Artificial Sequence
  Description of Artificial Sequence: Synthetic polypeptide
MRVMGILKNYPQWWIWGILGFWMLMICNGKGKLWVTVYYGVPVWKEAKTTLFCASDARAYEKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIK

SEQ ID NO: 823 - protein, 671 aa, Artificial Sequence
  Description of Artificial Sequence: Synthetic polypeptide
MRVMGIPKNYPQWWIWGILGFWMLMICNGKGKLWVTVYYGVPVWKEAKTTLFCASDAKAYKKEVHNVWATHACVPTDPNPQELVLGNVTENFNMWKNDMVDQMHEDIISLWDQSLKPCVKLTPLCVTLICSNATVKNRTVEEMKNCSFNTTTEIRDKEKKEYALFYKPDVVPLDETNNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLNTPVEIVCTRPNNNTRKSVRIGPGQTFYATGDIIGDIRQAHCNISEKQWNDTLQKVGKELKKHFPNKTIKYAQSAGGDMEITTHSFNCGGEFFYCNTAKLFNGTYNGTDISTNSSADSNSTITLQCRIKQIINMWQGVGRAMYAPPIAGNITCKSHITGLLLTRDGGTNSSEKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEKDIWDNMTWMQWEREISNYTETIYKLLEDSQNQQERNEKDLLALDSWNSLWNWFNITKWLWYIK

SEQ ID NO: 824 - protein, 671 aa, Artificial Sequence
  Description of Artificial Sequence: Synthetic polypeptide
MRVMGILKNYPQWWIWGILGFWMLMICNGKGKLWVTVYYGVPVWKEAKTTLFCASDAKAYKKEVHNVWATHACVPTDPSPQELFLKNVTENLNMWKNDMVDQMHEDIISLWDQSLKPCVKLTPLCVTLICSNATVKNRTVEEMKNCSFNTTTEIRDKEKKEYALFYRPDIVPLNENETSNTSEYRLINCNTSAVTQACPKVTFEPIPIHYCAPAGYAILKCNNETFNGTGPCSNVSTVQCTHGIRPVVSTQLLLNGSLAEKEIVIRSENLTNNAKIIIVHLHTPVEIVCTRPNNNTRKSVRIGPGQTFYATGDIIGDIRQAHCNISEKQWNDTLQKVGKELQKHFPNKTIKYKHSAGGDMEITTHSFNCGGEFFYCNTSNLFNGTYNGTYMNISTDSNSTITLQCRIKQIINMWQGVGRAMYAPPIAGNITCKSHITGLLLTRDGGTNSSGKEEIFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSETDIWDNMTWMQWEREISNYTETIYKLLEDSQNQQERNEQDLLALDSWNSLWNWFNITKWLWYIK

SEQ ID NO: 825 - protein, 672 aa, Artificial Sequence
  Description of Artificial Sequence: Synthetic polypeptide
MRVMGIPKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSTATVNKSTVEEMKNCSFNTTTEIRDKEKKEYALFYRPDIVPLNNKTSNTSEYRLINCNTSAVTQACPKVTFEPIPIHYCAPAGYAILKCNDETFNGTGPCSNVSTVQCTHGIRPVVSTQLLLNGSLAEEEIVIRSENLTNNAKIIIVHLHTPVEIVCTRPNNNTRKSVRIGPGQTFYATGGIIGDVRQAHCNISKGLWNDTLQKVGKELQKHFPNKTIRYNQSAGGDMEITTHSFNCGGEFFYCNTAKLFNGTYNGTDISTNSSANNSSTITLQCRIKQIINMWQGVGRAMYAPPIAGNITCKSNITGLLLTRDGGINSSREEEIFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGMWGCSGKLICTTNVPWNTSWSNKSEMDIWDNMTWMQWEREISNYTETIYKLLEDSQNQQERNEQDLLALDSWNSLWNWFNITKWLWYIK

SEQ ID NO: 826 - protein, 672 aa, Artificial Sequence
  Description of Artificial Sequence: Synthetic polypeptide
MRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWGNMTWMQWEREISNYTETIYKLLEDSQNQQERNEQDLLALDSWNSLWSWFNITKWLWYIK

SEQ ID NO: 827 - protein, 672 aa, Artificial Sequence
  Description of Artificial Sequence: Synthetic polypeptide
MRVMGIPKNYPRWWIWGILGFWMLMICNGKGKLWVTVYYGVPVWKEAKTTLFCASDAKAYVKEVHNVWATHACVPTDPSPQELLLKNVTENFNMWKNDMVDQMHEDIISLWDQSLKPCVKLTPLCVTLICSNATVENSTTDEMKNCSFNTTTEIRDKEKKERALFYRPDIVPLNNETGNTSEYRLINCNTSAITQACPKVTFEPIPIHYCAPAGYAILKCNDETFNGTGPCSSVSTVQCTHGIRPVVSTQLLLNGSLAEKGIVIRSENLTNNAKIIIVHLNASVEIVCTRPNNNTRKSVRIGPGQTFYATGDIIGDIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEIQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWSWFNITKWLWYIK

SEQ ID NO: 828 - protein, 672 aa, Artificial Sequence
  Description of Artificial Sequence: Synthetic polypeptide
MRVMGIPKNYPRWWIWGILGFWMLMICNGKGKLWVTVYYGVPVWKEAKTTLFCASDAKAYVKEVHNIWATHACVPTDPSPQELLLKNVTENFNMWKNDMVDQMHEDIISLWDQSLKPCVKLTPLCVTLICSNATVNQSTTEEMKNCSFNTTTEIRDKEKKEHALFYRPDIVPLDNETGNTSEYRLINCNTSAVTQACPKVTFEPIPIHYCAPAGYAILKCNDETFNGTGPCSKVSTVQCTHGIRPVVSTQLLLNGSLAEKGIVVRSENLTNNAKIIIVQLNASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNETETFRPAGGDMRDNWRSELYKYKVVEVQPLGIAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSETDIWENMTWMQWEREISNYTETIYKLLEDSQNQQERNEQDLLALDSWNSLWSWFNITKWLWYIK

SEQ ID NO: 829 - protein, 687 aa, Artificial Sequence
  Description of Artificial Sequence: Synthetic polypeptide
MRVMGIPKNYPLWWIWGILGFWMLMNCNGEGNLWVTVYYGVPVWKEAKTTLFCASDAKAYVKEVHNVWATHACVPTDPSPQELVLDNVTENFNMWKNDMVDQMHEDIISLWDQSLKPCVKLTPLCVTLNCSNAIVKNSTTEEISHALARNSTTEEMKNCSFNTTTEIRDKEKKEYALFYRPDIVPLNNKTSNISEYRLINCNTSTVTQACPKVTFEPIPIHYCAPAGYAILKCNDETFNGTGPCSNVSTVQCTHGIRPVVSTQLLLNGSLAEKGIVIRSENLTNNAKIIIVQLNANASVEIVCTRPNNNTRKSVRIGPGQTFYATGDIIGNIRQAHCNISEKKWNETLQKVGIELQKHFPNKTIKYNQSAGGDMEITTHSFNCGGEFFYCNTAKLFNSTYNGTYISTNSINSTLNITLQCRIKQIINMWQGVGRAMYAPPIAGNITCRSNITGLLLTRDGGIHNDSNVTETFRPAGGDMRDNWRSELYKYKVVEIQPLGIAPTGAKERVVERGKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWNNMTWMQWEREISNYTGTIYKLLEDSQNQQERNEQDLLALDSWNSLWNWFDITKWLWYIK

SEQ ID NO: 830 - protein, 684 aa, Artificial Sequence
  Description of Artificial Sequence: Synthetic polypeptide
MRVMGILKNYPQWWIWGILGFWMLMNCNGEGNLWVTVYYGVPVWKEAKTTLFCASDAKAYKKEVHNVWATHACVPTDPSPQELFLKNVTENFNMWKNDMVDQMHEDIISLWDQSLKPCVKLTPLCVTLICSNAIVKNSTTEEMSNATVKNSTTEEMKNCSFNTTTEIRDKEKKEYALFYRPDVVPLDETNNTSKYRLINCNTSAVTQACPKVTFEPIPIHYCAPAGYAILKCNDETFNGTGPCSNVSTVQCTHGIRPVVSTQLLLNGSLAEKEIVIRSENLTNNAKTIIVHLHTPVEIVCTRPYNNTRKSVRIGPGQTFYATGDIIGDPRQAHCNISKETWNKTLQEVGKELQKHFPNKTIRYNQSAGGDMEITTHSFNCGGEFFYCNTSNLFNSTYNDTYISPNSTNSTSTITLQCRIKQIINMWQGVGRAMYAPPIAGNITCKSNITGLLLTRDGGTTNNSNETETFRPAGGDMRDNWRSELYKYKVVEVQPLGLAPTGAKERVVEREKEAAGLGALFLGFLGAAGSTMGAASITLTVQARQLLSGIVQQQSNLLRAIEAQQHMLQLTVWGIKQLQARVLALERYLKDQQLLGIWGCSGKLICTTNVPWNTSWSNKSEMDIWGNMTWMQWEREISNYTGTIYKLLEDSQNQQERNEQDLLALDSWNNLWNWFSITKWLWYIK

What is claimed is:

1. A composition comprising a nucleic acid encoding one or more HIV-1 envelope polypeptides, wherein the one or more HIV-1 envelope polypeptides are any one of envelope:
CH0848.3d0949.10.17;
CH0848.3.d0836.10.31;
CH848.3.d0358.80.06;
CH848.3.d1432.5.41; or
CH848.3.d0526.25.02,
   wherein CH0848.3d0949.10.17 is a gp140C CH0848.3d0949.10.17 envelope comprising SEQ ID NO:820, or a gp120D11 CH0848.3d0949.10.17 envelope comprising SEQ ID NO:548,
   wherein CH0848.3.d0836.10.31 is a gp140C CH0848.3.d0836.10.31 envelope comprising SEQ ID NO:813, or a gp120D11 CH0848.3.d0836.10.31 envelope comprising SEQ ID NO:541,
   wherein CH848.3.d0358.80.06 is a gp140C CH848.3.d0358.80.06 envelope comprising SEQ ID NO:702, or a gp120D11 CH848.3.d0358.80.06 envelope comprising SEQ ID NO:430,
   wherein CH848.3.d1432.5.41 is a gp140C CH848.3.d1432.5.41 envelope comprising SEQ ID NO:778, or a gp120D11 CH848.3.d1432.5.41 envelope comprising SEQ ID NO:506, and
   wherein CH848.3.d0526.25.02 is a gp140C CH848.3.d0526.25.02 envelope comprising SEQ ID NO:718, or a gp120D11 CH848.3.d0526.25.02 envelope comprising SEQ ID NO:446.

2. A composition comprising one or more recombinant HIV-1 envelope polypeptides, wherein the one or more recombinant HIV-1 envelope polypeptides are any one of envelope:
CH0848.3.d0949.10.17,
CH0848.3.d0836.10.31,
CH848.3.d0358.80.06,
CH848.3.d1432.5.41,
CH848.3.d0526.25.02,
   wherein CH0848.3d0949.10.17 is a gp140C CH0848.3d0949.10.17 envelope comprising all the consecutive amino acids immediately after signal peptide sequence MRVMGILKNYPQWWIWGIL-GFWMLMICNG of SEQ ID NO:820, or a gp120D11 CH0848.3d0949.10.17 envelope comprising all the consecutive amino acids immediately after signal peptide sequence MRVMGILKNYPQWWIWGILGFWMLMICNG of SEQ ID NO:548, and
   wherein CH0848.3.d0836.10.31 is a gp140C CH0848.3.d0836.10.31 envelope comprising all the consecutive amino acids immediately after signal peptide sequence MRVMGILKNYPQWWIWGIL-GFWMLMICNG of SEQ ID NO:813, or a gp120D11 CH0848.3.d0836.10.31 envelope comprising all the consecutive amino acids immediately after signal peptide sequence MRVMGILKNYPQWWIWGILGFWMLMICNG of SEQ ID NO:541,
   wherein CH848.3.d0358.80.06 is a gp140C CH848.3.d0358.80.06 envelope comprising all the consecutive amino acids immediately after signal peptide sequence MRVMGIPKNYPQWWIWGIL-GFWMLMICNG of SEQ ID NO:702, or a gp120D11 CH848.3.d0358.80.06 envelope comprising all the consecutive amino acids immediately after signal peptide sequence MRVMGIPKNYPQWWI-WGILGFWMLMICNG of SEQ ID NO:430,
   wherein CH848.3.d1432.5.41 is a gp140C CH848.3.d1432.5.41 envelope comprising all the consecutive amino acids immediately after signal peptide sequence MRVTGILRNYPQWWIWGILG-FWMLMNCNG of SEQ ID NO:778, or a gp120D11 CH848.3.d1432.5.41 envelope comprising all the consecutive amino acids immediately after signal peptide sequence MRVTGILRNYPQWWIWGILG-FWMLMNCNG of SEQ ID NO:506, and
   wherein CH848.3.d0526.25.02 is a gp140C CH848.3.d0526.25.02 envelope comprising all the consecutive amino acids immediately after signal peptide sequence MKVMGILKNYPQWWIWGIL-GFWMLMICKG of SEQ ID NO:718, or a gp120D11 CH848.3.d0526.25.02 envelope comprising all the consecutive amino acids immediately after signal peptide sequence MKVMGILKNYPQWWI-WGILGFWMLMICKG of SEQ ID NO:446.

3. The composition of claim 1, wherein the nucleic acid is operably linked to a promoter inserted in an expression vector.

4. The composition of claim 1 further comprising an adjuvant.

5. A method of inducing an immune response in a subject comprising administering a composition comprising one or more HIV-1 envelopes and/or one or more nucleic acids encoding said one or more HIV-1 envelopes, wherein the one or more HIV-1 envelopes are any one of envelope:
CH0848.3.d0949.10.17,
CH0848.3.d0836.10.31,
CH848.3.d0358.80.06,
CH848.3.d1432.5.41, or
CH848.3.d0526.25.02,
   wherein CH0848.3d0949.10.17 comprises a gp140C CH0848.3d0949.10.17 envelope encoded by SEQ ID NO:820, or a gp120D11 CH0848.3d0949.10.17 envelope encoded by SEQ ID NO:548,
   wherein CH0848.3.d0836.10.31 comprises a gp140C CH0848.3.d0836.10.31 envelope encoded by SEQ ID NO:813, or a gp120D11 CH0848.3.d0836.10.31 envelope encoded by SEQ ID NO:541,
   wherein CH848.3.d0358.80.06 comprises a gp140C CH848.3.d0358.80.06 envelope encoded by SEQ ID NO:702, or a gp120D11 CH848.3.d0358.80.06 envelope encoded by SEQ ID NO:430,
   wherein CH848.3.d1432.5.41 comprises a gp140C CH848.3.d1432.5.41 envelope encoded by SEQ ID NO:778, or a gp120D11 CH848.3.d1432.5.41 envelope encoded by SEQ ID NO:506,
   wherein CH848.3.d0526.25.02 comprises a gp140C CH848.3.d0526.25.02 envelope encoded by SEQ ID NO:718, or a gp120D11 CH848.3.d0526.25.02 envelope encoded by SEQ ID NO:446,
   wherein the one or more HIV-1 envelopes are administered as a recombinant polypeptide or a nucleic acid encoding the HIV-1 envelope polypeptide, or any combination thereof, wherein the nucleic acid encoding the HIV-1 envelope polypeptide is operably linked to a promoter, and wherein the composition is administered as a prime or a boost in an amount sufficient to induce an immune response.

6. The method of claim 5, further comprising administering a second composition comprising one or more HIV-1 envelopes, wherein the one or more HIV-1 envelopes are any one of envelope:
CH0848.3.d0949.10.17,
CH0848.3.d0836.10.31, CH848.3.d0358.80.06,
CH848.3.d1432.5.41,
CH848.3.d0526.25.02,
  wherein CH0848.3d0949.10.17 comprises a gp140C CH0848.3d0949.10.17 envelope encoded by SEQ ID NO:820, or a gp120D11 CH0848.3d0949.10.17 envelope encoded by SEQ ID NO:548,
  wherein CH0848.3.d0836.10.31 comprises a gp140C CH0848.3.d0836.10.31 envelope encoded by SEQ ID NO:813, or a gp120D11 CH0848.3.d0836.10.31 envelope encoded by SEQ ID NO:541,
  wherein CH848.3.d0358.80.06 comprises a gp140C CH848.3.d0358.80.06 envelope encoded by SEQ ID NO:702, or a gp120D11 CH848.3.d0358.80.06 envelope encoded by SEQ ID NO:430,
  wherein CH848.3.d1432.5.41 comprises a gp140C CH848.3.d1432.5.41 envelope encoded by SEQ ID NO:778, or a gp120D11 CH848.3.d1432.5.41 envelope encoded by SEQ ID NO:506,
  wherein CH848.3.d0526.25.02 comprises a gp140C CH848.3.d0526.25.02 envelope encoded by SEQ ID NO:718, or a gp120D11 CH848.3.d0526.25.02 envelope encoded by SEQ ID NO:446,
  wherein the one or more HIV-1 envelopes are administered as a recombinant protein or a nucleic acid encoding the HIV-1 envelope protein, or any combination thereof, and wherein the nucleic acid encoding the HIV-1 envelope protein is operably linked to a promoter.

7. The method of claim 5, wherein the composition further comprises an adjuvant.

8. The method of claim 5, wherein the one or more HIV-1 envelopes are administered as gp120D11 recombinant proteins or gp140C recombinant proteins, wherein gp120D11 CH0848.3d0949.10.17 envelope recombinant protein comprises all the consecutive amino acids immediately after signal peptide sequence MRVMGILKNYPQWWIWGILGFWMLMICNG of SEQ ID NO:548,
  the gp120D11 CH0848.3.d0836.10.31 envelope recombinant protein comprises all the consecutive amino acids immediately after signal peptide sequence MRVMGILKNYPQWWIWGILGFWMLMICNG of SEQ ID NO:541,
  the gp120D11 CH0848.3.d0358.80.06 envelope recombinant protein comprises all the consecutive amino acids immediately after signal peptide sequence MRVMGIPKNYPQWWIWGILGFWMLMICNG of SEQ ID NO:430,
  the gp120D11 CH848.3.d1432.5.41 envelope recombinant protein comprises all the consecutive amino acids immediately after signal peptide sequence MRVTGILRNYPQWWIWGILGFWMLMNCNG of SEQ ID NO:506, or
  the gp120D11 CH848.3.d0526.25.02 envelope recombinant protein comprises all the consecutive amino acids immediately after signal peptide sequence MKVMGILKNYPQWWIWGILGFWMLMICKG of SEQ ID NO:446,
  the gp140C CH0848.3d0949.10.17 envelope recombinant protein comprises all the consecutive amino acids immediately after signal peptide sequence MRVMGILKNYPQWWIWGILGFWMLMICNG of SEQ ID NO:820,
  the gp140C CH0848.3.d0836.10.31 envelope recombinant protein comprises all the consecutive amino acids immediately after signal peptide sequence MRVMGILKNYPQWWIWGILGFWMLMICNG of SEQ ID NO:813,
  the gp140C CH848.3.d0358.80.06 envelope recombinant protein comprises all the consecutive amino acids immediately after signal peptide sequence MRVMGIPKNYPQWWIWGILGFWMLMICNG of SEQ ID NO:702,
  the gp140C CH848.3.d1432.5.41 envelope recombinant protein comprises all the consecutive amino acids immediately after signal peptide sequence MRVTGILRNYPQWWIWGILGFWMLMNCNG of SEQ ID NO:778, or
  the gp140C CH848.3.d0526.25.02 envelope recombinant protein comprises all the consecutive amino acids immediately after signal peptide sequence MKVMGILKNYPQWWIWGILGFWMLMICKG of SEQ ID NO:718.

9. The method of claim 6, wherein the first and/or second composition further comprises an adjuvant.

10. The method of claim 6, wherein the one or more HIV-1 envelopes are administered as gp120D11 recombinant proteins or gp140C recombinant proteins, wherein
  the gp120D11 CH0848.3d0949.10.17 envelope recombinant protein comprises all the consecutive amino acids immediately after signal peptide sequence MRVMGILKNYPQWWIWGILGFWMLMICNG of SEQ ID NO:548,
  the gp120D11 CH0848.3.d0836.10.31 envelope recombinant protein comprises all the consecutive amino acids immediately after signal peptide sequence MRVMGILKNYPQWWIWGILGFWMLMICNG of SEQ ID NO:541,
  the gp120D11 CH0848.3.d0358.80.06 envelope recombinant protein comprises all the consecutive amino acids immediately after signal peptide sequence MRVMGIPKNYPQWWIWGILGFWMLMICNG of SEQ ID NO:430,
  the gp120D11 CH848.3.d1432.5.41 envelope recombinant protein comprises all the consecutive amino acids immediately after signal peptide sequence MRVTGILRNYPQWWIWGILGFWMLMNCNG of SEQ ID NO:506, or
  the gp120D11 CH848.3.d0526.25.02 envelope recombinant protein comprises all the consecutive amino acids immediately after signal peptide sequence MKVMGILKNYPQWWIWGILGFWMLMICKG of SEQ ID NO:446,
  the gp140C CH0848.3d0949.10.17 envelope recombinant protein comprises all the consecutive amino acids immediately after signal peptide sequence MRVMGILKNYPQWWIWGILGFWMLMICNG of SEQ ID NO:820,
  the gp140C CH0848.3.d0836.10.31 envelope recombinant protein comprises all the consecutive amino acids immediately after signal peptide sequence MRVMGILKNYPQWWIWGILGFWMLMICNG of SEQ ID NO:813,
  the gp140C CH848.3.d0358.80.06 envelope recombinant protein comprises all the consecutive amino acids immediately after signal peptide sequence MRVMGIPKNYPQWWIWGILGFWMLMICNG of SEQ ID NO:702,
  the gp140C CH848.3.d1432.5.41 envelope recombinant protein comprises all the consecutive amino acids immediately after signal peptide sequence MRVTGIL-RNYPQWWIWGILGFWMLMNCNG of SEQ ID NO:778, or the gp140C CH848.3.d0526.25.02 envelope recombinant protein comprises all the consecutive amino acids immediately after signal peptide sequence MKVMGILKNYPQWWIWGILGFWMLMICKG of SEQ ID NO:718.

11. The method of claim 5, wherein the composition is administered as a boost.

12. The composition of claim 2 further comprising an adjuvant.

13. The composition of claim 1, wherein the one or more HIV-1 envelope polypeptides are any one of envelope:
CH0848.3d0949.10.17;
CH0848.3.d0836.10.31;
CH848.3.d0358.80.06;
CH848.3.d1432.5.41; or
CH848.3.d0526.25.02,
- wherein CH0848.3d0949.10.17 is a gp120D11 CH0848.3d0949.10.17 envelope comprising SEQ ID NO:548,
- wherein CH0848.3.d0836.10.31 is a gp120D11 CH0848.3.d0836.10.31 envelope comprising SEQ ID NO:541,
- wherein CH848.3.d0358.80.06 is a gp120D11 CH848.3.d0358.80.06 envelope comprising SEQ ID NO:430,
- wherein CH848.3.d1432.5.41 is a gp120D11 CH848.3.d1432.5.41 envelope comprising SEQ ID NO:506, and
- wherein CH848.3.d0526.25.02 is a gp120D11 CH848.3.d0526.25.02 envelope comprising SEQ ID NO:446.

14. The composition of claim 2, wherein the one or more recombinant HIV-1 envelope polypeptides are any one of envelope:
CH0848.3.d0949.10.17,
CH0848.3.d0836.10.31,
CH848.3.d0358.80.06,
CH848.3.d1432.5.41,
CH848.3.d0526.25.02,
- wherein CH0848.3d0949.10.17 is a gp120D11 CH0848.3d0949.10.17 envelope comprising all the consecutive amino acids immediately after signal peptide sequence MRVMGILKNYPQWWIWGIL-GFWMLMICNG of SEQ ID NO:548,
- wherein CH0848.3.d0836.10.31 is a gp120D11 CH0848.3.d0836.10.31 envelope comprising all the consecutive amino acids immediately after signal peptide sequence MRVMGILKNYPQWWIWGIL-GFWMLMICNG of SEQ ID NO:541,
- wherein CH848.3.d0358.80.06 is a gp120D11 CH848.3.d0358.80.06 envelope comprising all the consecutive amino acids immediately after signal peptide sequence MRVMGIPKNYPQWWIWGIL-GFWMLMICNG of SEQ ID NO:430,
- wherein CH848.3.d1432.5.41 is a gp120D11 CH848.3.d1432.5.41 envelope comprising all the consecutive amino acids immediately after signal peptide sequence MRVTGILRNYPQWWIWGILG-FWMLMNCNG of SEQ ID NO:506, and
- wherein CH848.3.d0526.25.02 is a gp120D11 CH848.3.d0526.25.02 envelope comprising all the consecutive amino acids immediately after signal peptide sequence MRVTGILRNYPQWWIWGILG-FWMLMNCNG of SEQ ID NO:446.

* * * * *